United States Patent 7,745,391 (HUMAN THROMBOSPONDIN POLYPEPTIDE) - sequence listing, part 145

SEQ ID NO: 378229 - DNA, 2201 bp, Homo sapiens
agaaaagcccgttccttattaaccaaaaggtaagatggccattgttaggcattttaaagccccataaactcaacagtgattgaaaaactccagaggggacatgtagctttttacccacctgagcatagaccaaatttacaactgttgctgtttatttcagctcttatatttttgtatgtaggagttctcaaatgccagactgttatttttaattagtgtttaaaagactttgctatatatagtcattaggctgtgttttaatcagggtggagtaccaccaaacctccaggaccctgtgatgggcatggacagaccagaggggaggatcagagcaggcaccgggcacctgtcacttgatgtccggaaaccatgaggtggcccccttccgtttagcataaaacatgtcctgttcttgcagctcaacttagttgttatatataacctcttagaacctttgagaagaacggctgtgggtgctaaggccagtgttgaattaggtggctggttcagaaacacctgcccaggctaacggggcagatctctatacagcgcaggggtgcttgggacctggtgggggcagatttctttaccttctgtgcccctatatttttgagataacgcagaaaggcttcccttgctctacatgtgaccgagatgcatatgtaaagctgcctttccagaagggtaagcttgctgcctccagctgttcctgctcctcatggcaaagtgcactgaggagttttgttggctgagcagcgtgttcgggatgtagcggctgcaagtgagaagcctattccatggttgctttagctcctgggctgccatcccggtctgtccctccctcttttcatgtggatgggccggtacaggcccacccacacagagaaggaagaaaggagggacgagattactattaaccattctttctatgtgtggtgcttctgtgtatgggctgtgttcacagagcatctgatctgttggtctgattttctgagtgtagcactgagtctgctgcggctgcttgccaagggcttgaatgtcgaggggttgtggggccagggttctgaatactatctcaggttatgcacaccctgcctgccctccatgtgcctgcatcacgtgatgtgaagacccaggtgtatgctcttcatggaggcaatgcccccgtgttcagaatgtgaaaggaaaagtgctcaaggacagacagagttgagagcatgggtggagtaggcaaaccatcccaggctacctcctgccttgccacccctctgcagggcgggcacaggctgcgctccttgatgctccttggcctggagagtgaagctgacctcaaagtcagccatcttgtatgtagcaggcctcaggactatgggcgggtgtgggccactgcagccagcacggaaaatgagccgaaggaaaatccgttccacagaagcaccttgtctttctgcagtttttgagtatatttctcaaatagccataaaagtttaaaaaatatatttgacagctaactctgggaacaaaacatgttatctaagatccctttttaagtaacacatttcctgcctgccttagcaggttctcttaagctgtaaaaatagctacccatggcagtgagatgaggatccctggaccttgcctttctgacctctttcccccaggaagtccatgactgaccttcaggcagcagcatctctgcaggctccacttgagcgctttcagatctccgcagactccactgagcgcttttagatctccgcagactccactgagcgctttcagatctctgcagactccactgagcgctttcagactggggccatgcctcaggggatgggctccccctgtgttgttttgctggtggccacgaatccgaaaggcccatgctgcagcgtgccctgctttgagtttggttgatatgcttaataagaacattagttttctgggagaatttggtagcacccgttcttcccttcactgtgtgggggaaatagtgttgattgaaaggaagaggactccgagattggattggagcaagaaagtgtgggtatcgtgtgttgtgactgtgtcttctccggggtgctgcttcactggaggtctcccttcagggtctggccctcatgcctggccccaggtgctcgtgtgcacgtgagcggctcttcctgctgactgactacagctaattgacaaaaggcagtttc

SEQ ID NO: 378230 - DNA, 1435 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378231 - DNA, 2138 bp, Homo sapiens
ttgcaatgtaaaaatatatcttggtctctgcatgatgatatattaacatctataccatggaacttttaaaaggaaaattgtgtggtataattaaaagaatattgcatgttatagagaaacttcacctgttgatttagcaggtgccattgtgtagatgctaagcaaatcttaatatgtttccttggatttttgaaatttgaatttgttgtgtaactttgctagttaaaagatttagagggatttggctgggcgcatggctcacgcttgtaatcccagcactttgggaggccgaggtaggcagatcacgaggtcaggagttcgagaccagcctggccaatacagtgaaaccctgtctcttctaaaaatacaaaaattagctgggcctcgtggcgggcgcctgtaatcccagctacttgggaggctggcaggagaatcacttgaaccagggaggtggaggttgcaatgagccgagatggcgccactgcaccccagcctgggtggcagagctagactctgtctcaaaaaaaaaaaaaagagtgggatttatcatagtttttttttcttaactgttattgactatttttaatttttattttttaattcagtggcctctcaggattattacctgcatttttttttcaggaaaatcccaattctgcaactaactctgtggccttagacaagtctcttgccttatccagggctgtttccttgtctgtaaaataaagagttggactagatgatctctaaggtcccttttacatctatagtttccttggtactatattagtgtttgatacaaaacaatttaatatatctaagccagttctccctgttatcgttgttgttttctatcattttatcattggaaacaacttggatttggttatggtaatttatatgatgcctcttggtacagttttgtgtatagtgttcctacatgcttgcatttgccagtacaaattacattcagcctataaaatagagatgaacttctgtattcaccagcacttcctttttccaattgtaacttttcattttccttctaaattcagagttttaaagtagaagtacttgctagtaatgcagatagagtcagttctctcaccagtatggatttaaattgtcctttccatctcagtttactcttttttttaaaaaaaacaaaccaatatgctacctgaaactagaaacacatttttaattctgcagctctcctaacagattattttgctttagtacagagctgggctgcaggctgagttgggagttggtaaaggattgaggacagcaatgtaggtcgcctcttcctacaggaaaaaattgaggaacgttgtgtattactggttaaaagattgattaggattatttcaagggatggttgagttgtcgttttacttatttcacccaatattttgtgtctctacttaagcagtgttgttttaaatgttactggataattgtaacataatcaaattaaattttatatttaactgatacccaagcatttgatgaaaacatgttgcaggaatgggagagtattccatagcttttgttttattgtgatttgattaaatgtgacaactaatagtttaaagacaggacttcactgttttagctgatttcctgtagaaagtgtggctaagtttaattgaaagaaatgtcttcttactagaactgattttgggggactttatccactcttacttggaacactaactgttggctataagggttcaaaaaggaagcaacagttgcttatttggcatgttgaaatatcactggctattttagagtatgaagcaaactttatcaatatgttttcttttccctccttacacacaatgtagactgatagaaaattagttttagttcttctagaatttatataaattttgtaagctcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378232 - DNA, 1576 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggtgaggatccagctccacccctgctcgcctgccgggcggtcgaggtctcgaagagaagacggcctgagttctgcaatactgggcctgccgcctaccctcgctgagcctcagtttgctggcctgtgaagtgggcgtggtcacgaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378233 - DNA, 934 bp, Homo sapiens
ataggctaggtactgaggcctggtgttaaatcggccgagggagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378234 - DNA, 1307 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378235 - DNA, 1386 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggtgaggatccagctccacccctgctcgcctgccgggcggtcgaggtctcgaagagaagacggcctgagttctgcaatactgggcctgccgcctaccctcgctgagcctcagtttgctggcctgtgaagtgggcgtggtcacgtaagggcttgtaggtggagcgcagtgggagggatttgtccctgaagttgatcagcatggaatgaagcatcctttggagggaatcgggcgaacccggtcctgggcttggaaaagctgggaggcggcgtccctgccccgcgctgacctcttactcgcgcctgttgctgcaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagagaggtaagtgaggccaggccgccctgctcaggaaaccgacactggactatccttcatgagggaaggaaggacatctggaggccacctgagccaagcctagaggatgtccagtattactaccagagaggtgttttgaatcgaattgaaattgagtcca

SEQ ID NO: 378236 - DNA, 1605 bp, Homo sapiens
  misc_feature (1600)..(1600): n is a, c, g, or t
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctcaaaaaaaaaaaaaaactcgtgccgaattcggcacgaggctctagggagattcttcaagcaatcactatgtcaacagacacaggtgcttcccttccttcatatgaggaagatcagggatcaaaactcattcgtcgtgcatatggattatataaactgaagagcaggngaact

SEQ ID NO: 378237 - DNA, 1746 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggtgaggatccagctccacccctgctcgcctgccgggcggtcgaggtctcgaagagaagacggcctgagttctgcaatactgggcctgccgcctaccctcgctgagcctcagtttgctggcctgtgaagtgggcgtggtcacgtaagggcttgtaggtggagcgcagtgggagggatttgtccctgaagttgatcagcatggaatgaagcatcctttggagggaatcgggcgaacccggtcctgggcttggaaaagctgggaggcggcgtccctgccccgcgctgacctcttactcgcgcctgttgctgcaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378238 - DNA, 1416 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagagcctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378239 - DNA, 1296 bp, Homo sapiens
ggggcgcagggctcgggacgtcaaagccctgcgtccttcggcccccagagcggagaagcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggtgaggatccagctccacccctgctcgcctgccgggcggtcgaggtctcgaagagaagacggcctgagttctgcaatactgggcctgccgcctaccctcgctgagcctcagtttgctggcctgtgaagtgggcgtggtcacgtaagggcttgtaggtggagcgcagtgggagggatttgtccctgaagttgatcagcatggaatgaagcatcccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 378240 - DNA, 311 bp, Homo sapiens
agggcttattttttatgttagacatcaatgtcaatgttactacattctcggatgctaacataaattttgaaattgctcttgtgctttaagcatatattgaaagtatggaagttaaatgttcaggcttttcagtaagctcaaaaagttaactgtaagcgatagtgttggtgttttctaaaatacaaaaatgttccagtgtaattaaaaggaattaaaatcttgaagatattttcctgtaatttaaggatactttttaaatgtaagaaaagacatgtcattaatttattgtcatgtttatacctctgtgagat

SEQ ID NO: 378241 - DNA, 354 bp, Homo sapiens
ttgagatggagtgttgctctgtcgcccaggctggagtacagtggcgcaatctcggctcactgtgatctctgtctcctgggttcaagtgattctcctgccacagcctcctgagtagctgggattacaggcgtgtgccaccatgcccagctaatttttctatttttagtacagatggggtttcaccatgttggtcaggctggtctcgaactcctgaccttgtgatccacttgcctcagcctcccaaagtgctgggattataggcatgagccaacgtgcctggccctttttttccttcataattgagatttcactggttgtgttgaagatcagtacacagacatttcaatttgtacc

SEQ ID NO: 378242 - DNA, 416 bp, Homo sapiens
  misc_feature (30)..(30): n is a, c, g, or t
  misc_feature (43)..(43): n is a, c, g, or t
  misc_feature (52)..(52): n is a, c, g, or t
  misc_feature (63)..(63): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (168)..(168): n is a, c, g, or t
ccagctggccgaaaagggggatgtgcctgncaaagccgaattnaagttgggntaaacgccccnggttttccccaagtccacgacgttgtaaaaacgacgggcccaagtggaattgtaaatacgactcaactaatagggcgaaattgggtacccgggccncncncnccnccgcgaattcggcacgagtaacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378243 - DNA, 2766 bp, Homo sapiens
ttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacagcaacaggagagatggacccctgtgtgtcagccctgaaatgtgggcagatccctcctgaaaactccgagtggcctctctgtgtctctggctcaggaaagaagtgagagaagccctatctctgagcaggctgagggctgcaggcaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378244 - DNA, 1286 bp, Homo sapiens
tttttgagacagggtcttgctctgccgcccaggctggagtggcatatttggcctacgtggcaaatgtaaagtatcttggagaatgttctaatgttctgaaaaccagagatctaagccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378245 - DNA, 1009 bp, Homo sapiens
gcgattctcaagtcaagtcaagacccatgggatgcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378246 - DNA, 656 bp, Homo sapiens
gttcatcattcaatatatgttttctgaacaccttctgtgttcaaggcaccatgctggcttctagggggactcagtggtgaaaagcctgaccccagtacctgttcttacagaactcatagcctagtgggagcctagatatcagacacggatcaggtagacagtatggacaatcatacatggtcataaatgctttccatcctgtacaaagtaaaggctgcagcgtcagaggtcgcagggggacctgacttagattggggaaccagagaaggctcctcttaggaagtgacctttcagatgagacctgaagggtttgcagaaaagaaccaggtggagagtgggcaaagccagggaaagagcatggcacagttgaggcaccgagggggtgccagtttgactgacggaggcaagggagcgcccaggtggggctgcagggccaccatgcaggccttttctcactggtgttccccggttctgtccatagcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctgga

SEQ ID NO: 378247 - DNA, 2622 bp, Homo sapiens
ttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378248 - DNA, 2560 bp, Homo sapiens
ttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcatcgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 378249 - DNA, 972 bp, Homo sapiens
ctctttttaccacactgtctatatactgcatgagccatttatatgaaactatctgacactccaaggcatcttatactatatattcaaccatgtatccctagtacctagcacagtcctggcatatagtttgctactaaacttttacagaatgaaggaattatcttgtatccagtttccaagttttaaggtgattcttcactaaaaaaaaagtattacagttcacaaataacctacttccctttttacaaatgggatcaattttaatcttatctcctaataacattactttcatttactctgatctaaatatactgtcctaagagagcaatagcggagagagagccggacagactccattttagtttcttcacgtgcagccccctttaccttccacccttaattgcataactagtgtaaactaactcaaagcaggtccaggaatgcacttactgataagatattgaggcaagctgcaccagctgctcctgggtacgcactcggtgaatgtcacgcaaaacccctgcatttctctctttgtgatagtttaagcccctgcacctggaactgtttatttgttttgtaactgctattgtaaccaattaatattttaactatttgccagctctgcttctgtaaaacttgtttcagctaaactcccccctcccctatttagaccacggtataaaaacaaaaccagccccttcctcggggccaagagaattttgagcattacatgcctctcggttgccggctaataaaggactccttaatttgtctcaaagtgtggcgttcctctataactcgcttggttacaacagtccacactgtggcctgaggtgcatcgcccacctgagcttcatctgttatgtatgtcagggaatataagcagggtgagagtggcctcatcagaggaccccagatctctggcttacccatctggcaagcgcacctctgtgagcaaagacttcagag

SEQ ID NO: 378250 - DNA, 875 bp, Homo sapiens
gcgacagcgacagagcctggagagggaggctctgctcaggatttatccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaagtggtgggattgctgaatcagacggagccaatagatgatcagtaatggtggccaatcatcagctagaaagaaagtgcttagcagggcttgaaaacaccaaaactctgagaccactgaccttcaaaaacttcaacagccctgagtgaaaagcccaaacacatttatctaccattcaaagacgcttcattgtctgttctctgtgcatctcagtagtctctttttaccacactgtctatatactgcatgagccatttatatgaaactatctgacactccaaggcatcttatactatatattcaaccatgtatccctagtacctagcacagtcctggcatatagtttgctactaaacttttacagaatgaaggaattatcttgtatccagtttccaagttttaaggtgattcttcactaaaaaaaaagtattacagttcacaaataacctacttccctttttacaaatgggatcaattttaatcttatctcctaataacattactttcatttactctgatctaaatatactgtcctaagagagcaataagaaagagagttgaagctggagtttgaagaattgtacatggtcctgtgataccctaccttgttttaacctgagtgactctctcctagcggagagagagccggacagactccattttagtttcttcacgtgcagccc

SEQ ID NO: 378251 - DNA, 266 bp, Homo sapiens
  misc_feature (221)..(221): n is a, c, g, or t
  misc_feature (223)..(223): n is a, c, g, or t
aacatgcgaacggactgatccaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttcgcangntggggatactctagatcgactatcagaatcaggtgcactgccg

SEQ ID NO: 378252 - DNA, 4703 bp, Homo sapiens
ctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagctgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378253 - DNA, 6482 bp, Homo sapiens
ctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagctgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaagctgctcaaaagttgacttctctagtcacgttgttccaagtgtggaagtagcccttctccaaccccagagttcaggtagatctgcccaaatgaaacagtccattcactttgcactctgtggggtcatcttcatagaaataattaataccaacatcacagtacatttctgtcatgcatttgatttgttcctcctatgattatttatgtgtagacttcattttccaccttgaactgtgaactttttaggaacaagtgggattttaccctaagacttttaatcttcctagtctggagggaagtggaccattaaatttttacatgagagtataaatttaacatcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttaaacaccattccagtactgcaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378254 - DNA, 4300 bp, Homo sapiens
tgctgggattacaggcgtgagccaccacgcgcggcctaaaatcaatgcattattaagaatatccgggggggatctggaatctgttaactgcctatctgaagtggcattctaattctagtttttgtgtttactttaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378255 - DNA, 2576 bp, Homo sapiens
ctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagctgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaagctgctcaaaagttgacttctctagtcacgttgttccaagtgtggaagtagcccttctccaaccccagagttcaggtagatctgcccaaatgaaacagtccattcactttgcactctgtggggtcatcttcatagaaataattaataccaacatcacagtacatttctgtcatgcatttgatttgttcctcctatgattatttatgtgtagacttcattttccaccttgaactgtgaactttttaggaacaagtgggattttaccctaagacttttaatcttcctagtctggagggaagtggaccattaaatttttacatgagagtataaatttaacatcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttaaacaccattccagtactgcaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggtaagtggcacaggagacttcctcagatggcagcatgcttggtatactcccttttcagctctaggccttttataacggtgcagtgattgcgggcaagtgccaaacatcgaaagtgtcaaaattgcatttcatattttcctgaccagtgggaagactaagaaaaactttttgtccttttttgtcattggactaaaacttgaggtgtaagaagaaacaaaattttgttacttaaaagttacgaagcctgctgtatcccac

SEQ ID NO: 378256 - DNA, 1735 bp, Homo sapiens
ctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagctgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaagctgctcaaaagttgacttctctagtcacgttgttccaagtgtggaagtagcccttctccaaccccagagttcaggtagatctgcccaaatgaaacagtccattcactttgcactctgtggggtcatcttcatagaaataattaataccaacatcacagtacatttctgtcatgcatttgatttgttcctcctatgattatttatgtgtagacttcattttccaccttgaactgtgaactttttaggaacaagtgggattttaccctaagacttgtttcctactctatttgaggtcatcggagaccatcctttatcatggatgggaaaattttcaggtgagctcaagagatcctctgacg

SEQ ID NO: 378257 - DNA, 466 bp, Homo sapiens
attcattatctcagcagccaaccacctttacaaaaatgttgataccagtcttctgtgagcacccaccttcttagggtgtgttgatttccatagattttactcctcttgttatttccataggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccggtgggtatattcattttggagggtgggaactgcagcaacagggaagccagagacttccttctccttggtcaccaccaaaaccaacacttccaaaatttcagcctagccacattcctcaaggaaccggttagagctggttgcagtagtgggttctgaacacttattaacata

SEQ ID NO: 378258 - DNA, 4710 bp, Homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378259 - DNA, 4535 bp, Homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaagaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378260 - DNA, 4391 bp, Homo sapiens
aactgtaatgatgatgaactgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaa

SEQ ID NO: 378261 - DNA, 7315 bp, Homo sapiens
ctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagctgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaagctgctcaaaagttgacttctctagtcacgttgttccaagtgtggaagtagcccttctccaaccccagagttcaggtagatctgcccaaatgaaacagtccattcactttgcactctgtggggtcatcttcatagaaataattaataccaacatcacagtacatttctgtcatgcatttgatttgttcctcctatgattatttatgtgtagacttcattttccaccttgaactgtgaactttttaggaacaagtgggattttaccctaagacttttaatcttcctagtctggagggaagtggaccattaaatttttacatgagagtataaatttaacatcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttaaacaccattccagtactgcaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaaaaaaaaaaaaaaaaaaaaaaaaaaaaaaaaaaaaaaaaaaaaaaaaaaaaaaaaaaaaaaaaaaaaagaaaaaaaaaaaaaagaaaagagaaaaacaagaacaccaccacccaccaactacgcaaaccgacggacgccccaaccccacgcgcgcgtcgcaccacacagccacgcgacacgcccccaaccaaccccacccccgccacacccacaaccaccggccccgcaaccaccacgacccacacaacccccacctcatgcggggcacaaacacaaccgcgcaccacacaccaacccgacccagccggccaccaccgccgcccaccgcgacgaccccaccccccgtcgccgcaccacggacccgcagcggcacccgcccccgcccacacacgcacccgcgcccgccgcccccacaaagcgcccaccccgccgcggcgcggaccgcacaccacaaccacccccccaccacgaggcggcgcgactacaacaaccaagccgcgcccgccaagcccaccacgaccccacgaacgaccgcaccccgcggcccgtacacgccacctgctccctaccactccgcccagctggagagcaacaacatccacacaacctaaccaggatacaagcaggcagctgacccacacatgctcattcacaccaccagatcacgcgccgcaacaaacacagcaaaccacccacccggacgacagcaggccacaacagcgagcgcacatcaccgcgcaccccacgcaggcgccacgagaccgcaccaccagcaaccccacagccactcgcgctccgccaacaccgaccagagacccaccaccccacaggcc

SEQ ID NO: 378262 - DNA, 786 bp, Homo sapiens
gcagtatgattattctctcaagtttgcatttcatgagtcatttactcatgctgtgttttgtagagtcttcctgaaggtgttgggttctctggtggtgagtatatctttcttaaattgctgctgtggtaggccttggtaaagttcaactgggttggatggggaagttctttgaactctttcaaaaatcaccaaactacagataatcgcaaatctagcagagggaaaatatcagttatttaactttgaaaacaaatccaactttgtattttagaaattacttgcaagacagtaagtccatgattttacaacacaattgcacttgtaggtttaaaattagaagtaaatagcatagtaaatgctcattcaatagttgtttaatgaattaagtaattatattgtttgtataattttgaggaactagaaagatgagtgaggcgatttcaatgtgtacatgagggcaacaatcgtgtataatatctacttggcacttcacagagggcatgactctttccataaaaatatttagtatgttcatgatgtcttttatctaaagaatttcatgctttagatattagtcaattctcaaaacactactctgaggaaggtgagtgacacacccctttatagacgaagaatttgcagttgaggctggttaaatgtgactaactcaagattaacactggtggtaggagacttgtctctggcctcattctgtgcccatgacctgctctttgaccttcaggaagctttatagcctcctcctgtccaacctccctcccttaaaaa

SEQ ID NO: 378263 - DNA, 6553 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378264 - DNA, 506 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcaggtagctgcccgccgcccgggccccgcgccgcctccgccacaagatggctccgggggctgcgcccgccgaccccgccgcgggctgcctgactggcgggcgggcgggaggggtggccgagaggccggcggcatccctcccctgcgggcgggcaggcgggcgggacgcggcctccggggcgcatccgcggggggcgagcgcacgtgggggctagagctcctgtgaaccccggggcgggaggggcatcctgggcccggcacccatgctggggcagcccccttggccggttgggtatttaggtctgcctcaggtggaagtcccgggaactacctgttgaatgccaa

SEQ ID NO: 378265 - DNA, 5847 bp, Homo sapiens
  misc_feature (40)..(40): n is a, c, g, or t
ataggcaggtgaaggccggggggtaatcggacgagggtgncatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378266 - DNA, 4072 bp, Homo sapiens
aatggagcccctctgggaacaggaacctgcttcagccctttagcatacacaggcctgccacgtgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378267 - DNA, 2886 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccg

SEQ ID NO: 378268 - DNA, 3042 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaacccta

SEQ ID NO: 378269 - DNA, 5154 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378270 - DNA, 6212 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378271 - DNA, 4195 bp, Homo sapiens
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaaatacaattttatcaagtatgtgttaaaaaaaatca

SEQ ID NO: 378272 - DNA, 475 bp, Homo sapiens
caagcactgcgaaaggacgctaaggaaagtgactaaaagcagagggtgctgggcatcagagcaaaacggcgctagcattgaacagctcctaggagggtcatgtcacagctgagagtgcgctggctggcattccctccagaaggctgggagaaactcagcagcagtggttggccattagtgcccaaaggaaagcctcctgaaaactcttctgtgacagcacacaaggatccctataagacaattccaatttggctggcttggtgcatttacttccaagctagatgtgtctctgcagcctttccttgcccatttggaaatctcgcccttgtggagctgctgagaaaatggctttctctaaaatccctgttccagaagatcaggcaggtgaatgaaaatcactatctgaataagacacaggatgaataaaaacaagagagatatacaaaaagggagatattccactcaaacccccaac

SEQ ID NO: 378273 - DNA, 1958 bp, Homo sapiens
cagaaaatatctacaaatcacatatctaattaacatccagaatatataaagaactccaacaattcaacaatagcaacaaaacaatctaattcgaaaatgggccaaagacttcaacggacatttttccaaagatataaaaatggtcaacatgaaaagatactcaacatcactagctattagagaaatgcaaatcaaaacaataagacaccgctccacgcccattaggatagctattatttgaaaaaggaaagtaactgttggcaaggatgtggagaaattggaacctttgtccactgtcagtgggactggagaacagtaaagtcactgtggaaaacagtttggcaatttctcaaaaatttaagcacagaattactatatgatccagcagtttcacttcttagtaaatatccgaaagaactgaaagcagggactcccatatctacatgtacgccaattttcatagcagcattgtttacagtagccaaaggtagaaacatcccaagtgcccattaacagatgaatgaacaaaatgtggtatatatgcacaatggaatattactcagtctcgaaaaggaatggaattctgatgcacaagccttgaaaatatactaaatacaccaaactcaaaaggacatattttatgatttcacttacttgagccccagaataggcaaattcatagatcaccaggggctgggggatccaggggaatagaaagttagtgtctaatgggtacagggtttctgtttggatgaaaaagtactggaaatggacagcggggatggttgcacaatgttgtggatgtccttaatgccaccgaattgtacacttaaaaacagttaaaatgaaaatgttccctcttcactattttggaagactatgagaaggattagtgttaattcttccttaatgtttagtagaattctccagtgaagtcatctggtcctgagctttccttagttcgaagttttttttgttttgttttgttttttggttttttttttgagatggagtctcgctctgttgcccagactggagttcactggcacaatctcagctcactgcaacctctgcctcccaggttcaagcaattctcctgcctcagcctccggagtagctgggattacacacacctaccaccatgcttggctaatttttttgtatttttagtagagacggcgtttcgccatgttggccaagctggtctcaaactcctgacctcaggtgatcaacccacctcggcctcccaaagtgctgggattacaggcataagccaccgcactcagcctgttgggaggtttttgattactgactcaatcttcttatttgttactgatctgctcaagttttctatttcttcatgattcagtcttggtagtttgcacgtttttagaaatttacccatttcttctaggttatccaattttttggcatacaactgctcataatagtctcacgatactttttattttcatggtatcaattgtaatgtctcctctttcatatctgattttgtgtcttctgtttttcttagtctagccaagggtttgtcaattttgcttatcttttcaaaaacccaactctttctttgatttttttctattgtttttttctattctgttttcatttattctgttgcaaattattttcctccttctgctcactttgggattagcttattctttttctagtttgaggtgtacaattaggctgtttgagatctttcttatttttttaatgtaggcatttactgctataaacttccctctcagtggtgcttttgctgcatcccaagggttttggtatgttgtgttttcattcgttcaaaacatcatctaatttcccatttgatttcttctttggctcaatggttaagactgctgtttaccaagggtgtgtttaatttccacccatgaagccagcattaccctaataacaaaataggattaagacactac

SEQ ID NO: 378274 - DNA, 434 bp, Homo sapiens
tttatctctcccctgaactactagggtgagagtaggaactttttctaattcacttctgtgtctccagctccctaagatcattgcctggcaaatagtaactgtgcaataaatatttgttgcatgagagtgaaagtgaggcaagcacattgcttttgtctggagtagtgtgttactagggtagctttgggggatgatggagattatgaaggggctacatccttcccacccctaaccccttcctggtgcctccatttactggaatatgctacacttgaaccataggataaggccagggtatagctgaggaaggctgccttatttggcagtcttgtagggaatttgtttgcttggatcccattccggtggagtcacccaaaggtcttgttccatctgaaaaactacacttgagaccaaccttggtcttgggttggcaa

SEQ ID NO: 378275 - DNA, 552 bp, Homo sapiens
agttgtctgggggaagagcattagggacaaaggggatggcaagtgcacagactctgaggcaaaagggaggctagcgtgttccaggaaaatcagggaggccagagtcatgggggtcggtgggggagtaggcaagaaagaggatggtaggagaggaagtcaagaggtaatgggaggccaggtcctgtgggaccttgtaggccactgtagcactttgatgtggctgagatgggaaactaccagaggattttgaatatagaggagtaatatgattggactcatattttaaaaggatcactgatggctgtgttaagagtagacatgagagaatggggggcaaggtggcagacaggggaccagttaaaagactctagtgataatccaggcaagcgatggcagtggcttaaactagggtggttttggaagagagaactggttggattctggatttatgttgaaggttgagctgacacaggatttgctgatgggttgtatgtggtatatcaaaagagagtagtcaagaatgaccattaagattttggcctgagcagttgg

SEQ ID NO: 378276 - DNA, 362 bp, Homo sapiens
aagtagcacggattgctcatccgatccgtgccgccgcagggagtgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcact

SEQ ID NO: 378277 - DNA, 948 bp, Homo sapiens
atgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccaattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttga

SEQ ID NO: 378278 - DNA, 470 bp, Homo sapiens
ggcaaagatccaagacaaggaaggcatccctcttgaccagaagaggttgatctttgctgggacacagctggaagatagatgcaccctgtctgactacaatatccagaaagagtccactctgcagttggtcctgcacttgaggggaggtgtctgagtttttcctttcttttaagctttcaagaagtctcattgcactcagtgcctgatgcattgtcagcaagaagtaaccataaaagactcccctatattaattccattattcatataagatggttgagtgagctaattttttttgctttgaatcttgtaaactgtagataagaatgaaacaatgtgtgtgcttggcctcacccatctttccactggacagtcaaatgacgtgtgactgtgttggctctgcaagctcccatacccctagctggaccagagaatcaggcagaagtcatttggagtctaaggattgctgcttt

SEQ ID NO: 378279 - DNA, 1622 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378280 - DNA, 1387 bp, Homo sapiens
ttcttttgagacagggtattgctctgttgccctggctggagtgcagtgctcattccagctcactgtaacctcaaacccatgtgctcaagggatcctcctgcctcagcctccccagtagctggggcaacaggcacatgccaccatgcctggctaatttttaatttttttgtagagagccttgtttcccaagctgctgcactattttctataagggacttgagtatctggagattttggtcttcatgggggtcctggaaccaatccctcatggatgcgtgagggatgactgtatatcatacacacataaagtttactggcttctgcaaacaaattttgagcccattaaccaaccagcctggtcaacgaatgtacatctaaagtaagatatatacgtgctaaaattgtttttaactaaaaatgccatatgtagtgtagaaatgaaaactagacactatttcattcgcatccattgagataatagtggtgagcacttaggataagcaccaggcttgacttgctgctcttgtcacttgtccttggaaatttaggctctattacaccaccaactctcaaatcatttccctgttgtagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378281 - DNA, 614 bp, Homo sapiens
tggttttttaaacacccctacagatgggaaaataaaccgccattttcccctggatatgaagggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378282 - DNA, 609 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtcaataattttttagttatcccattttgaagagcccaagtggttttaacg

SEQ ID NO: 378283 - DNA, 1037 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggattagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggaggtaggtaccttatgaaattagtagcctgtgtagtttttttagtttgatgaatttaagaaaaaaaatttaaccagggcataattattaatgcacttattaaaccagatgttcagttttaggttttgtttttaactgaagactttttaatttaaattggaacttccactttattctcattgtaagcgctgtatgtaagagagaacatgcttatcttttacagcgtagactaggggtgtccaatcttttggcttccctggccacattggaagaagaattgtcttaggccacacataaaatacagtaacactaatgatatcttatgagccaaa

SEQ ID NO: 378284 - DNA, 889 bp, Homo sapiens
aatttagctttttttttccattccatattttatatcagaaagaaatgtagctttttttttcactttagcaacatgttggccaaaatgttgaaatactgcctagtagagacatcctttcaatgacgatgaagtgtaattttatttagtgatttagacatgtgacttacgaatttattttattttatttttttatttttttattttttggaacaaagtttcgctcttgttgcccaggctggagcacaatggcatgatctcggctcactgcaacctctgcctcccaggttcaagcgattctcctgcctcagcctcctgagtagctgggattacaggcgcccgccaccacgcccagttaatttttgtatatttagtagagacagggtttcaccatgttgaccagggtggtcttgaacttctgacctcaggtgatccacctgcctcggcctcccaaagtgctgggattacaggtgtgagccaccacgctggcatgaatttttaatagtatttcagatagcattttttctcggtgacattgttgacatatacttagcaaaatatttctatataaaattatcacaatttcctaattattcaaattggaattactatatatgtttatgtatctctcaaggttatatttttcagcattctagttacatatttacatgatggctgatatgcaaataccgtaattctcacctaccaatcttcactgattttccaacaccctcatgaagatggccagaaaagacacacacacacccctaccacttcaccaccaggattctagattggccttgcatctgccatgtacttatcacctcgctgtttcatcattttggaccatgaaatagaaaatattatcgtttacgttattaaagtttatgtg

SEQ ID NO: 378285 - DNA, 475 bp, Homo sapiens
ggcggacacagtggcctgtgcctgtagtcccaactactcatgaggctgaggctggaggattgctggagtccaggccagcctgggcaacatagtaagaccttgtctctaaataaataagaacttgtttgaagaataaatttttgtcagattattataaaatatatttcttctctctctctttttttaaaactattcccttgcaagtgagattatatagtaaagatgatgaaccagctgtaaaactacaactactaccacataaacatgatatcatcacacttcttggtgttggaggccactgggtaacaacagaagaaaaccttcaggtactatcagaagtataaagcgttgagattacaccaaaggggtgtaattaacaaacaataatgcctaagttatttgaggcaaggtatgactaaattagtataaaatctgggccaggcatggtggctcacacctatgagtccagcactat

SEQ ID NO: 378286 - DNA, 1643 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttcttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378287 - DNA, 1954 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttggacctgggaggcagaggtttcagtgagccaagattgcactactacactccagcctggtgacagagtgagactccatctcaaaaaaaaaaa

SEQ ID NO: 378288 - DNA, 1416 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttcttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatatttt

SEQ ID NO: 378289 - DNA, 1279 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatatttt

SEQ ID NO: 378290 - DNA, 1592 bp, Homo sapiens
agcagggggcgggctctctgacgaaggactggaaggtggcggtggtgaaggtgcaggccgttggggcggctcagaggcagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378291 - DNA, 1480 bp, Homo sapiens
taacatttgtatttcaagaaaaggaagatcttccttttcttgaaatacaaatgttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378292 - DNA, 1832 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttggacctgggaggcagaggtttcagtgagccaagattgcactactacactccagcctggtgacagagtgagactccatctcaaaaaaaaaaa

SEQ ID NO: 378293 - DNA, 1744 bp, Homo sapiens
gcatgatggtgcatgccattagtcccagccactcgggaggctggggcacaagaatcacttgaacctgggaggtggaggttgcagtgagccaagatcgtgccacaaactccagcctggttgacaagagcagaactccatctcaaaaaaaaaatgaataaagtcaactaaataggcaaagagagagatacttctcctggtcacaataatcgcatggcccaaatatctagagaatccagatttgaagtgctgtatatcctgtagtctttacagaccatcaaaatgttattgacattttggtccttttttccacattaaacaaaatcagtctttttacaaatccacagattttaaaaatgtattttaatagataagaattatatttaataaacttgtaatattaactattaattttcttcactctttagttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378294 - DNA, 1020 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggaggttatatttttcagcattctagttacatatttacatgatggctgatatgcaaataccgtaattctcacctaccaatcttcactgattttccaacaccctcatgaagatggccagaaaagacacacacacacccctaccacttcaccaccaggattctagattggccttgcatctgccatgtacttatcacctcgctgtttcatcattttggaccatgaaatagaaaatattatcgtttacgttattaaagtttatgtg

SEQ ID NO: 378295 - DNA, 1070 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcaggtactatcagaagtataaagcgttgagattacaccaaaggggtgtaattaacaaacaataatgcctaagttatttgaggcaaggtatgactaaattagtataaaatctgggccaggcatggtggctcacacctatgagtccagcactat

SEQ ID NO: 378296 - DNA, 1128 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggaggtaggtaccttatgaaattagtagcctgtgtagtttttttagtttgatgaatttaagaaaaaaaatttaaccagggcataattattaatgcacttattaaaccagatgttcagttttaggttttgtttttaactgaagactttttaatttaaattggaacttccactttattctcattgtaagcgctgtatgtaagagagaacatgcttatcttttacagcgtagactaggggtgtccaatcttttggcttccctggccacattggaagaagaattgtcttaggccacacataaaatacagtaacactaatgatatcttatgagccaaa

SEQ ID NO: 378297 - DNA, 410 bp, Homo sapiens
taaataatataaagaaatcaattcgatatggcctctgttctataaccatacacccactgtatatttttttctacacaggcatttggtacaatagctattcagttagcacatcatagaggagccaaagtgatttcaacagcatgcagccttgaagataagcagtgccttgaaagattcagacctcccataggtgggtaatattatgagcacagactttaaaacaggaaattttgaaggaaaatcacctttaaaaatgtacttgtaaaaccaagtacaaaatccctggccaggtgcagtggctcacaactgtaacctcagcaccttgggaagccaggatgggaggattgcttgagcccaggagtttgagaccagcctgagcaacatagaagacctcatctatatataatctt

SEQ ID NO: 378298 - DNA, 804 bp, Homo sapiens
ttctttcattacgataataggaaataataatagcagttaagtttccttaagtattccaaacagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgt

SEQ ID NO: 378299 - DNA, 1395 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatatttt

SEQ ID NO: 378300 - DNA, 654 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttgaagtactttcccggctgggtgctgtggctcacgtctgtaatcccagcacgttgggaggccaaggtgggcgaatcacctgaggtcgggagttcgagaccagcctgaccaacatggagaaacctcgtctctactaaaaatacaaaattagccaggcatggtggcacgtgcctgtaatcccagctactcaggaggctgaggcaggaaaattgcttaaacccaggaggcagaggttgtggtgagccgagatcacaccattgcactccagcctgggcaagaagaatgaaactccatctcaaaaaaaataaa

SEQ ID NO: 378301 - DNA, 813 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttgaagtactttcccggctgggtgctgtggctcacgtctgtaatcccagcacgttgggaggccaaggtgggcgaatcacctgaggtcgggagttcgagaccagcctgaccaacatggagaaacctcgtctctactaaaaatacaaaattagccaggcatggtggcacgtgcctgtaatcccagctactcaggaggctgaggcaggaaaattgcttaaacccaggaggcagaggttgtggtgagccgagatcacaccattgcactccagcctgggcaagaagaatgaaactccatctcaaaaaaaataaaacaaaaacaaaagtgggggggccgggcccgaaaaatttttcaacactcgggggggggcgcgccagagaaagacaatggcacgggcccgggaacgggggcagggggtcccaaaaaacccgggcggggtgcaccagggggggcggtcaagccactcccccg

SEQ ID NO: 378302 - DNA, 1762 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttggacctgggaggcagaggtttcagtgagccaagattgcactactacactccagcctggtgacagagtgagactccatctcaaaaaaaaaaa

SEQ ID NO: 378303 - DNA, 1659 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378304 - DNA, 1622 bp, Homo sapiens
  misc_feature (976)..(977): n is a, c, g, or t
  misc_feature (980)..(981): n is a, c, g, or t
  misc_feature (985)..(985): n is a, c, g, or t
  misc_feature (1000)..(1000): n is a, c, g, or t
  misc_feature (1006)..(1007): n is a, c, g, or t
  misc_feature (1012)..(1012): n is a, c, g, or t
  misc_feature (1015)..(1015): n is a, c, g, or t
  misc_feature (1023)..(1023): n is a, c, g, or t
  misc_feature (1025)..(1025): n is a, c, g, or t
  misc_feature (1035)..(1035): n is a, c, g, or t
  misc_feature (1042)..(1042): n is a, c, g, or t
  misc_feature (1048)..(1048): n is a, c, g, or t
  misc_feature (1052)..(1052): n is a, c, g, or t
  misc_feature (1056)..(1056): n is a, c, g, or t
  misc_feature (1096)..(1096): n is a, c, g, or t
  misc_feature (1099)..(1101): n is a, c, g, or t
  misc_feature (1109)..(1110): n is a, c, g, or t
  misc_feature (1112)..(1112): n is a, c, g, or t
  misc_feature (1114)..(1114): n is a, c, g, or t
  misc_feature (1117)..(1117): n is a, c, g, or t
  misc_feature (1120)..(1120): n is a, c, g, or t
  misc_feature (1130)..(1130): n is a, c, g, or t
  misc_feature (1177)..(1177): n is a, c, g, or t
  misc_feature (1185)..(1186): n is a, c, g, or t
  misc_feature (1190)..(1190): n is a, c, g, or t
  misc_feature (1192)..(1192): n is a, c, g, or t
  misc_feature (1202)..(1202): n is a, c, g, or t
  misc_feature (1210)..(1210): n is a, c, g, or t
  misc_feature (1212)..(1212): n is a, c, g, or t
  misc_feature (1214)..(1214): n is a, c, g, or t
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatctcccaaacgcaccacnnccnnaacnccctactcccctaancgatcnnacgcngcncctccccncngcccctcccnccccccncccccncccncccncccccccccccccccccccccccccccccccccccccccnccnnncccccccnncncnaanccnaccccccccncccccccccccccccccccccccccccccccccccccccccaccccnccaccccnncccncnatcccccccngaaaccgntnanaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378305 - DNA, 1599 bp, Homo sapiens
ggtggctcatgcctgtaatcccagcatttcgggaggccgaggcagacggatcacaaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378306 - DNA, 1360 bp, Homo sapiens
  misc_feature (22)..(22): n is a, c, g, or t
ctcaacgctttatacttcatcntctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378307 - DNA, 1543 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaaaaatg

SEQ ID NO: 378308 - DNA, 1091 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggaggtaggtaccttatgaaattagtagcctgtgtagtttttttagtttgatgaatttaagaaaaaaaatttaaccagggcataattattaatgcacttattaaaccagatgttcagttttaggttttgtttttaactgaagactttttaatttaaattggaacttccactttattctcattgtaagcgctgtatgtaagagagaacatgcttatcttttacagcgtagactaggggtgtccaatcttttggcttccctggccacattggaagaagaattgtcttaggccacacataaaatacagtaacactaatgatatcttatgagccaaa

SEQ ID NO: 378309 - DNA, 727 bp, Homo sapiens
gctgcatgatctacagatacctcaagaaaaaggatttgagaacagggctcctctgtgagcagcagtcctgggacagcaaagcccaatttcagatcccgcataaaacacaattgttctctgcaaataatgcagctaactgtgaaccaacccctacccacaactgggccagtatgtttagagagctgagagaggctttcattgaaaaagaattactgtatttgacctgataatttaccttctaggaatcagtcctagagaaatatgtagaaattcagataaggacttatctgaatctctatagaagacatgcagtgccttaaaatgggggtggggggagtccatttaagtgcatacagctttttaaagaatattttgtggcaggagaaagtgcatgtggtataaagtagaaaaggcacgatatgatattatacatgcttgatatggaatttcatattctgctcatgttaaagggcagagagaaaagacggcgaggaaatacagcagaatattaacagtagttgtctctgggagataggatttcaaacgtttctactttcttcccaaatttcccacaacaagcatatactaattttataatcaacaatatttaggaaaaaaatagtaaatttgttcaatattttccaaggtagacattgcgcccgggtgcatttgaacccagtcacacagcagcaaggtagctatctctgttcccagggtacccagttag

SEQ ID NO: 378310 - DNA, 705 bp, Homo sapiens
ttttttttgagacagagtctcgctctgttgcccaggctagagtgcagtggtgtgatttcttctcagcaggtgcagacacttctctgaagaccaacagcagaactgagtctcaggatgggtaaaggcttctgtaaacctccaaatcacatccctcttcttgtccaaccacccaacctctccacaggcaacctgatcagccacctttatacaaagtacagtattcagattggaataaaaatatatctccttgactccctgctctgagaggtatttcttctcagactcccaaaagctggattgaggaacatggcttagttggtacagtatagcaaaatgtcctgcttgttgaaactgaatttgtgattatcttctttttcctcaagaagtcattgagggctgttgtatccctataaaaggagaatttagagtagccaaataaaagggggctgaagtagtctcattacggaaaaagagagtgtgagcagccttttagtaattgattgcctcaagatgtggtattcagccagggtgaagggaaagtagttggggctgtggatctggaggtttacagaagcctttacccatcctgagactcagttctgctgttggtcttcagagaagtgtctgcacctgctgagaagaaatcacaccactgcactctagcctgggcaacagagcgagactctgtctcaaaaaaaaaaacaa

SEQ ID NO: 378311 - DNA, 384 bp, Homo sapiens
gagaacttttaaaggggattttcacaatttcaatagcccagcagtatcctctcactctcttttccttttccactgctacatggaatggaaggagctgctcgctgtgttaaaatgtggagattattttgaaaatttgaatatgaagaataagtgtcttaagccattctctcatttttataaagaaataacctgagactgagtaatttataaagaaagagttttaattggttctcggttctgcaggctgtacgggaagcatagtgacatctggtcccggggaggccccaagaagcttacaatcattgtggaaggcaaagtgggagaaggtacatcacatggcaaaagcaggagcaagagagtgaagggtgaggtgccacacacttt

SEQ ID NO: 378312 - DNA, 358 bp, Homo sapiens
atgcagtattcaagttcagaaatctatactcagatgaccttatgtaggtcatctgcttctgaggtttatctcaccagtggtcccagaaggctgcatatggaactgacctggacttaatctacaagatagatacccccagctaacctgcaaactcacagagtgatgatcatagaaacctgtattaagaaaacagatttcaggagcctttgaacaagaagagagaggaagaatgacataactgaacaagagagatggcgagcagagtttcctgaatgctgtgagcagaacaattggacagatgagggaagtctgtgacaatccagtggaatcacgcagtgtgtttaagtaaagctccctt

SEQ ID NO: 378313 - DNA, 732 bp, Homo sapiens
ttcaatatagaggatgaggaaagtagaattcaaggatggagcccaaattcttgacttgagcagctgggtaatagagccaaatgacataccatttattaacatgaagtcttggggttgggacaattttccttgggggaaaaatttacagaagtggaattgcaaagtcccctatttccttaaatatcctcatgcatctctttgtccagatatgctgtagcattgttatattgttttagtattattctatcagatccccctggtttaaacaatcagatgtagcaaaatatattgtagcccaattcacttaggtatacttacgtaaaaagaaaataacaaaggaacaaggaacatgtgctgtgggagaaattcttatagtcaaagtggaacagacagagttggcaaagtcctatgatatccccaaagtatttcaaattaaacttcgatatggaaattctgattatataagtttgataccatattaggatattgactacattttcccctgctgaatgaaaatctggctttagattaaaatggctatctaagttatttggtaacctgatggggttaaggatgttagttatattactaagtaacattatgacaaaaatgaccccttgattggtaaattaatttggactgggaagaactgcaaaggaatgataaatacctgatggggacactgtactttggaatgtcctgagttacttgtaattggcataccccttgtgt

SEQ ID NO: 378314 - DNA, 1244 bp, Homo sapiens
tccaagatgaaaccaatgagtcacaacattcacataatacactgtacaaccctgatctcttgactgtcatcaaatgtttcttacctctaaaccaaagtttcattttataatttaatttttctcattttttccattctcttagcttaagaaaagatcattacaaactttttgtaagtttttcatatatgcttgcaaagggttgtaaaactttattgtgattattcttgctttaagctgaaacttccctaatctttctttagagattgtggcatagcatgttagtttcttttccatatccaattgttttctgttatgaatacagaaatacaggcactgtcttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaatgttttccacagaattaaattaaatatgaatcatccctcctctgatttttgaaatgaccctttgcttcctatgataatgattcttctggtccgttttgtagttatatgttagagtttgtaaatagtcacacattttgcaactgcatataattttcttattattttttcctcttcctctaaaatgcactccagcctgggtgacagagcaagactccatctcaaaaaaaaaaaaaaaaaaattatgttaaaataaaggtcatcaaaagatattttcctaaacctttcctttaccagaaatatctctagtgtcacatggtcctttctcccttcttgcttttgtaggaatccaaagctaatctgtccctgatccggattgcacgcacctgtgccttttggggcccttctgcattagttcttccttctcttctaacctcaaaaatgtgttttctctattggctctttccctttaacatagaagtatactcacgcttttgttgaatcttgaaataaaaggcttcctttaccacatatctccctttaatactacatctctcttctcagccaaatacttgggaagagaagccctgagtttgtgtcattgttttctcacctccagttcactactttgcccactgcctgacatccagctcgctcacacacacacccaagcccaatc

SEQ ID NO: 378315 - DNA, 1738 bp, Homo sapiens
tccaagatgaaaccaatgagtcacaacattcacataatacactgtacaaccctgatctcttgactgtcatcaaatgtttcttacctctaaaccaaagtttcattttataatttaatttttctcattttttccattctcttagcttaagaaaagatcattacaaactttttgtaagtttttcatatatgcttgcaaagggttgtaaaactttattgtgattattcttgctttaagctgaaacttccctaatctttctttagagattgtggcatagcatgttagtttcttttccatatccaattgttttctgttatgaatacagaaatacaggcactgtcttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaatgttttccacagaattaaattaaatatgaatcatccctcctctgatttttgaaatgaccctttgcttcctatgataatgattcttctggtccgttttgtagttatatgttagagtttgtaaatagtcacacattttgcaactgcatataattttcttattattttttcctcttcctctaaaactgctgttatttcttttaactttttgtgggaaaaattaaacccatctttcactttgttgatatacttatttataattgaactccttgatttttgctcgaattgcttttcaagttacccacttttagggaagacattatttgggttttgtttagtgtatcaggctttttttagttagttgtatcaagaagtgtagacttttctatacataatatcctttttcccacagtatttttttttttttttaaagtctagccaggtgcgagtggctcacgcctgtaatcccagactttgggaggccgaggccggcggatcacgaagtcaggagatggagaccatcctggctaacacgttgaaaccccgtctttactaaaaatacaaaaaattagctggacatggtgacgggtgcctgtggtcccagctaatcaggaggctgaggcaggagaatggcatgaacccgggaggcagaggttgcagtgagccgagatcgtgccactgcactccagcctgggtgacagagcaagactccatctcaaaaaaaaaaaaaaaaaaattatgttaaaataaaggtcatcaaaagatattttcctaaacctttcctttaccagaaatatctctagtgtcacatggtcctttctcccttcttgcttttgtaggaatccaaagctaatctgtccctgatccggattgcacgcacctgtgccttttggggcccttctgcattagttcttccttctcttctaacctcaaaaatgtgttttctctattggctctttccctttaacatagaagtatactcacgcttttgttgaatcttgaaataaaaggcttcctttaccacatatctccctttaatactacatctctcttctcagccaaatacttgggaagagaagccctgagtttgtgtcattgttttctcacctccagttcactactttgcccactgcctgacatccagctcgctcacacacacacccaagcccaatc

SEQ ID NO: 378316 - DNA, 404 bp, Homo sapiens
taaattaagaggttatgtttttcatatggtgttaaataatcacaataaaaagccaaacactgtgtaagtaaaatcaaatactgtataagtaaatcaaaacatgtatatagtaaaactaaatcatgtatctgatatttaggacaccggatgtcttgcttgaggccagaatcatatgttcagtgtttattgtttaagaacaaaacagaagttttggaatacatgtgttataaaatccttgaggggaaacatgaaatgttcgaacttatatatagtcttgatagtaggtattctatagtatgtattttgctaatagtttgtgccagtagacaatgatggatatatgaattgtttatgccagtgaatacaattcactaagtaataaatgaaaacagtatttgcttttc

SEQ ID NO: 378317 - DNA, 570 bp, Homo sapiens
atgtgaatttgtatagatgtcgaagaaatgactgcaattttgtgggacctggttttggggcttctatgaagggaagatcttgtgcaaaaaatttgtgtatccagctgtagttgctgccatcttttaaaagcatgatgcctctgtcaatagatctgacattaatatgatataattacatattgatggactcattttattagaagcacttgcctttttcttggttatttgacttatacttgacggccagtttctcatgtatagaaatgtgtagcctggccatgtgcagtggctcatgcctgtaatcccagcaatttgggaggcctaggagggtggatcacctgaggtcaggagttcgagaccagttggccagcctggccaacatggtgaaaccccatctctactaaaaatgcaaacaaaaaaaaattagccaggcatggtggcaagcgcctgtaatcccagctactcgggaggctgaggcaggagaatgctgaacctgggaggcggaggttgcagtgagaggagattttgccagtgcactccagcctaggcaacaagagcaaaactccatct

SEQ ID NO: 378318 - DNA, 365 bp, Homo sapiens
gccttcctgggccatgcaagactacatttcccagcctcccttgcagctaggtgtggccacgtgatggaatggaagcgattcatgccatttccaggcctgggctaaaaaacacctcccatgtgatcttttctcccactcacctccactgctggaaagacgcagggacccagcagagggcttggaacctctgagggacagcagagccacaagagggagggagcctgggctctgaatcaccacgtgaatggcgggtagatgctcactgaatacctgcactgcgctgttacaggagagggaaatccacttccactgtatgaagtcactgagattcggggctgtctgttacagcagctgatttaccatga

SEQ ID NO: 378319 - DNA, 414 bp, Homo sapiens
tcaactgaaagtcttactgtataatatgacctcaacaaaattggacagtgctgcatagtcaagaaagggatagcaaactgaaagaactgatttagtggtattgccatctagctagcttacttaggaattatttctgatgactttaatttcaataaggcaggactaattcctttatccacatttccatctatatctttgttggatgtttggggatggaagagtccaatagtaaaagggaagtagattcttatgtggcctcaaggaaacattgtgtattagtatgggactggataactagttatctaatatctagttactttatatatttgagcataaatttaacaattaatgatactgatttaagagactgattttgtcaatcaaatgacattttggaggtaggtaaaaaaaaaa

SEQ ID NO: 378320 - DNA, 477 bp, Homo sapiens
catacctcgcagggatgatacagataaattgtttgataatttaaagtcctttgaagaataagaattccttagaaatgctaattgccttactagtgtttgatttaacttcgtctgccagaatgggcaagggaaaagaaaaatggaaagttgccttacccttgtgggttgctttaggaaactgtgataacaacatatcctgaagtgaatacgataccttatattcttagaaattctggatattggctgggcatggtggctcacgcctgtaatctcagcactaagctgaggcgggcggttcacctgaggtcaggagttcgagaccagcctggcaacatggtgaaaccccgtgtccactaaaaatacaaaaattagctgggcatggtggtgcacgcctgtaatactagctactcgggaggctgaggcaggagaattgcttgaacctgggaggtggaggttgcagtgagccaagattgcgtc

SEQ ID NO: 378321 - DNA, 452 bp, Homo sapiens
ggggaaacactagatatattaagattagtttgaatttaatatatgaacttgaattttagtattacaagggattagttttaatttgggaaattgtatccaattttcagaaattctacatttgcattaaagcagcaccaaatttgttttttaaattaaaagcaggctataatgttcatagaaatgtgctatggccaggcacagtggcttatgcctttaattccagcattctgggagcccgaggaaagaggatcacttgagcccaggatttcaagaccagcctgagcaatatagacctggtctctacaaaaaaattttttaaaaattagccaagcacggtggcgcatgcctgtaggaggatcacttgcgccctggaaatagaggttgcagtgagctgagatagcaccactgtactccatccagcctggcaacagagcaagaacatgtctcaaaaa

SEQ ID NO: 378322 - DNA, 710 bp, Homo sapiens
tgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagtagcacatgagtaggatattaaaggataagtaggttttgaagacggggacagaaagaaggaaaattgtggtcagggccaggggagaaaacaaggagtaactttctttggcaggaatgagggtgattcatgctggaatggtaggctggggtcagactgtggtgctataaatgcggggagagagattagagaaggcagcatgaagaatggagagaaaatgagtttgaagttgagcagacccgggttcagattttcatgctgccacttgcaaactgtgtgatgttggccatcaaggactgtgaactggctgggtgcagtggctcacacctgtcatcccagtgctttgggaggccaaggcaggaggattgcgtgaggccagaagtttgagactggcttgggcaatatagcgagacgatctttac

SEQ ID NO: 378323 - DNA, 254 bp, Homo sapiens
ttgaagagatggggtctcgctatgttcatcaggatggtttcaaactcctagcctcaagtgatcctcctccgttgacctcctaaagtgctgggattaccagcatgagcgactgtgcccgaccacctagctccttttaaatgttttcatgtcctgacccttcttaagtctttaaaatatagaaaatgcccttggtaaggaatgttaaaagtgtttgtgtatttttatggcctacttcctgtttagaaatgttctgt

SEQ ID NO: 378324 - DNA, 676 bp, Homo sapiens
ccagtggtggggctgggatttgagccaagtcttccaacttcacaatagcagagtaagaagagctgccttgttgatgggacgtgggtcggagctcccagtgtgtcttgccttcctggtgtgcttgatggcagccctgggctgctgtgaggtcctgagcacagtgcatcctgaggagacagtgctgcgggccccgcctactaacttccagagatgtcagctgcagcagggcagcgccctggttagagagacggcatggggagttggcagggggaggccctcggagaagatggcatggaggggttggggcctgtgctcctaggtgcttaggcttgcaggtgactggaatcctgactaatatcataagaggagagttcttactaacaaattacttgaacaaagactttgtttgttccttcattcgttcagcacatgtttacagtgtgcctgtgatgtcccaggcgcactgccagaatcctgacatccttgtggggggatcgaaaacataaatctagtcagtgagttcatcctgtggcatgtcagggggtgacagtggctgtggaggaaacagggaagggcagggtgtgggagtcctggtgctgtgtgaataggccgtcaggtcagccctgagacacggggcatctgcgcgagtcttgctggaggtgcacgtgtgagcccc

SEQ ID NO: 378325 - DNA, 1525 bp, Homo sapiens
gtccctcaaggccggaaagaaagtcgggcttctctagcccctggaggactcgactcactggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaaaaaaaat

SEQ ID NO: 378326 - DNA, 1470 bp, Homo sapiens
gtccctcaaggccggaaagaaagtcgggcttctctagcccctggaggactcgactcactggtgcgcgatttaggtccggaggaggcgttgtgagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaaaaaaaat

SEQ ID NO: 378327 - DNA, 714 bp, Homo sapiens
gtccctcaaggccggaaagaaagtcgggcttctctagcccctggaggactcgactcactggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacatta

SEQ ID NO: 378328 - DNA, 1433 bp, Homo sapiens
gaggaaagaggcgcgttcctagccgcgggactgggtgacccgcctctcccccaaattagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaaaaaaaat

SEQ ID NO: 378329 - DNA, 1544 bp, Homo sapiens
gtccctcaaggccggaaagaaagtcgggcttctctagcccctggaggactcgactcactggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacacgtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtg

SEQ ID NO: 378330 - DNA, 424 bp, Homo sapiens
gtttcaccatgttggccaggatggtctcaatctcctgacttcatgatccaccagccttggcctcccaaagtgctgggattacaggcgtgagccaccacgcccggcctagttttaaaatgtttaattgtgaagttgaaacttttgttggtgtgcgcgatgactgcaaatctattgtcttttgccttccaagcatagttctacttttccaagagccatgcaaaataagccttcatatgcttttgagtctatgtggttttttcacgaagagaattcattgctagagaatctgtaaatcttttatggcatattttaaaaaataaaataatggaattaagtagaaactgtaaacgtttctactttatttaattgatataggattatattcttagatttattttgttgttctttttaaatgttagcaaca

SEQ ID NO: 378331 - DNA, 383 bp, Homo sapiens
gagatccttgagaaaaagtgaaaacaccctgcagtaataaaaagctgaacttaggaactgtacatttacatgatggaagatgaaaacccagggtttggttagagtctagaagcaattatggctcttcttctctctcaacatcttgtttgttttgctttgttaatgtaaagcaagcacctctgttacttcttattttaaaccacttctctatatactcactgtaagcaaacattcagggctgaggtaggagatagggactttccaagtaaaactgtgtagtgctacaaggaataaaaacaagtgcacagacattttgtacactttatttttgattaacagtgagaaaaaatgcaatagtgtcatagttttttgtaggcagtctc

SEQ ID NO: 378332 - DNA, 327 bp, Homo sapiens
tggagagacgaagtctcactatgttgctcaggctgatctcaaaatcctgggctcaagcagtcctcccacctcggactcccaaaatgttgagattacaggtgtgagccactgtgccaagctatctttgttttacttgtgtctttattctggccactgtaagtaatagcgaatgccagattgtgttgcctgagtgtgctgtcgtacagactaggaccgagtctaacacgtcctgacacagccaagcagaatgaaaatgcacgaggcaaaaacaatggcagtcagagctttagaaagccagagagcaaccatcttattaataacgagact

SEQ ID NO: 378333 - DNA, 346 bp, Homo sapiens
tggtaaaacccaaatcatatccagaatcctagttgcaagagtatgggaaaggtaattttatgttccagcctctgaagaaagaatagcatacgagactaacatgagatggagctataccccactggctacttaacacccagcacaaccttctacccacacttaacaccactagcaacagcaatgtgctcctacctaatgtgacaacactatgtttcacacctatgaaaacaatctcatcttcccctgtgaggagaagacccaaaattccatcagtaactgcatccatccagtcaccactgggtgacactcaattctttcctagttcagtcaccatactatttggaca

SEQ ID NO: 378334 - DNA, 309 bp, Homo sapiens
aacagcttcatgacattggatttagcaagatttcttggatatgactctaaaggcacaggcaacaaaattagaaatagataaattggactacatcaaaatttaaaactttggtgcatcaaaagacaccatcaacagagtgaaagggcaacccacagaatggaataatatatttacaaatcatatatctgataagagattaagatctagaacatataggccgggcactgtggctcacacctgtaatcccagcactttgggaggctgaggtgggtggatcacctgcggtcaggagttcgagaccagcctggc

SEQ ID NO: 378335 - DNA, 311 bp, Homo sapiens
gtcctacaggcctcagcctattttttgttcctcagaggagacttttatgactgctgtattataaatagatctcccagtttctcttattctctttcttagtcttttatttgttgctttcattatacatattagaatttgtaatcattttacttatttctgtttacttgtatacttaaaaatctattttccccactagaatgtaaactccatgaggtcagggccatgtctattttgtcaccattgattccctgtgcctaacagtgcctggcagagcaggcagccatcagcctggcaggatgtttgattgattg

SEQ ID NO: 378336 - DNA, 327 bp, Homo sapiens
gaccaacatgggtgtatgcaaacatgtatcagggtttgtcaagctcatcattactggtatcgtgagctgaatgattttttgttgcagaggactgtcctatgtgatgcaggacatttagcagcattcctggtctccagacattatcaaatgttctggggctgtggggtgggagatcactcttggttgataaccactgataaactacaacaaatatatttaatttccccttcaaattctttgaggacaaagactatgaccttgcttattttatattctcgatattaccaaatatagcagtttatgacagatttagataaatatttgttt

SEQ ID NO: 378337 - DNA, 811 bp, Homo sapiens
actagcagattttccatgaaaataccatcgtaaagaattgtacatccagaatatgacgaaaatgttttgttctcagatgtcagtaacattaaccagacatttaaaaagagaagcacttgatgaacaccacaccaatagtactatccattattatcagattcctttacagtcttggactgccgatctttttttctcctataacatcatattagaaaaaaataacagcatagtgatgctgagttttttaaaaatgagattactggaaaaatgcaaatgtttttatggtagaactgaagtcataaatgacattattttttgaatgagacttttagctttttcagacccaattaatttaatttccttttaaaaaggcccttcctgtagtcctccaggacaactgagataagcttgggtgttcccgccattattcccctggattaatgtggggccctagaggtgaggcttattcagacaccatccctcaagtagactgggcccagtgcagttcaaagcaagcattttcatttgtttcatttttcctatttagaaatggcatttgagttttataactaatacggaatactggcattaatgagtagcaacaccaaagatctgccaaaggtacaaatataatttaagcagttaaaagagttagcttttcagaagctgtaagattgtttatttcattatttttaatgtgcttgcaaaccccataagcagcgggcctcacttgccaaggacagtagatctataccttggtcaaacagaccttccagccagcacctcttcttgtcatcattcaatattacca

SEQ ID NO: 378338 - DNA, 321 bp, Homo sapiens
ggtgataataaccattaccatctgtgagatgtccttagggtaccaagagttttatagaacctataacatggcaaattcctactcacagtcttattcaaaaacatattattctataccctatcacttttaatggtgaaacaataactcaatttcgcaaaatattttatccccaactctttacctttgtcatccactaaggtttttagtttttaaaattaatgacttcaatctttattttaataacatttttattataaaaactctaactccgagaaatggttataaacttacacttttcctaataggaatgtaagtttctca

SEQ ID NO: 378339 - DNA, 394 bp, Homo sapiens
tttcaagaaagcaggctaattattttgtagaaggcccctcagtttgggtttctctgtttccttatgattagattcagattatgcctttataataggaatctgacagaagttatgctgtattcttctcagtatgacatatgagacagtatgtgatgttactttgtctcatttctagtgatgttactttgactaatatcagatttgttgtttctcagattcttccactataaagttattatttttacctttgtaatgcattattttgtgggggaaaagctttgacactatgtaaatgttccattcctcaataaaccttcacctacttgttttagcatccattggtgttctgtgtctgaatccatcattatcctgacagttgccaagtggtgatatt

SEQ ID NO: 378340 - DNA, 382 bp, Homo sapiens
gatggctggtggcctgtgcgccaacccacacctctgtactacaacctaagatttggcatcttaggttgcaggactcctccctggagtctccctacccagactgggggcattggcagggcagagccagggcctccatccagaagtgatggccctgctccttcccactggccaatagacagctgctgtggcctgactccaagccatctcccctacccctggcctgagggtccttacaggcaaaatgaagggtttggaggagatggcccggtgctgacaagctgtgactcaatttaggccttgaaagccagcactgtattctccatgcccctaccctgctgcggggtcggggaagtgtggaccgagatggaagtgccgctggact

SEQ ID NO: 378341 - DNA, 463 bp, Homo sapiens
accaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacaccggtcagatcgtcctccaaaaaccactacactcctgtgcgtacggccaagcagactccaggacgacttcaataggtatcttctcagttcaaggatgttcacttacataaacctggtaattgtatcatagttagtcgacgcggccgcgaat

SEQ ID NO: 378342 - DNA, 743 bp, Homo sapiens
cactctaccaccatgaatccactcctgatccttacctttgtggcagctgctcgtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtcagtgt

SEQ ID NO: 378343 - DNA, 714 bp, Homo sapiens
aggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtcagtgt

SEQ ID NO: 378344 - DNA, 585 bp, Homo sapiens
cactctaccaccatgaatccactcctgatccttacctttgtggcagctgctcgtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctggagtctacaccaaggtctacaactatgtgaaatggattaagaacaccatagctgccaacagctaaagcccccagtatctcttcagtctctataccaataaagtgaccctgttctcactgtcagtgt

SEQ ID NO: 378345 - DNA, 719 bp, Homo sapiens
cactctaccaccatgaatccactcctgatccttacctttgtggcagctgctcgtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaaggcccgcgtgtccaccatctctctgcccaccgcccctccagccactggcacgaagtgcctcatctctggctggggcaacactgcgagctctggcgccgactacccagacgagctgcagtgcctggacgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtcagtgt

SEQ ID NO: 378346 - DNA, 1036 bp, Homo sapiens
tcttcatcattgcattaccatcacccaacactatcaggggacctgccctgataatcagtctacagttgtatccagcagctccagagagacagcgaccagcaagaaggggccatgatgatggtggtggttttttcaaaacgaaaagggggatatgtagggaaaagaaagagagatcagactcttacagactcttactgtgtctacatagaaagggaagacataagagactccatttggaaaaagacctgtactttaaacaattgctttgctgagatgttgttaatctgtagctttgccccagccactttgccccaaccactttgacccagtctggagctcacaaaaacatgtgttgtatgaaatcaaggtttaaggcatgtagggctgtgcaggatgtgccttgttaaccaaatgtttgcaagcagtatacttggtaaaagtcatcaccattctcttgtctcaataaaccaggggcacaatgcactgtggaaagccgcagggacctctgcccttgaaagctgggtattattcaaagtttccccccatgtgatagtctgaaatatggcctcgtgggatgagaaaggcctgacggtcccctagcccgacacccataaaaggtctgtgctgaggtggattagtcaaagaggaaagactcttgcatttgagatagaggaaggccactgtctcctgcctgcccctgggaactgaatgtctcggtataaaacacgattgtacatttgttcaattctgagatgggagaaaaaccgccctatggtgggaggtgagacatgtttacagcaatactgccttgatattctttactccactgagatgtttgggtggagagaaacataaatctggcttacatgcacgttcagtcatagtaccttcccttgaacttcattatgacatagattctattgctcacatgtttgttgctgaccttcttattatcaccctgccctcctactacattcctttttgctgaaataataaagatagtattcaataaaaactgagggaactcagagaccgg

SEQ ID NO: 378347 - DNA, 1058 bp, Homo sapiens
acccactagacatttgaaattctacaatgaactcatcagggatgcaaatgaaagtgcctctgcagagacagaaaacccgcaatcgagcatcatcgactcgcagggtgaacaaaatggtgatatcagaagaacagatgaagttacaatccaccaaggaaactgcacatgtggagagtcagggagaggaagagaaagaaaaactcttacagactcttactgtgtctacatagaaagggaagacataagagactccatttggaaaaagacctgtactttaaacaattgctttgctgagatgttgttaatctgtagctttgccccagccactttgccccaaccactttgacccagtctggagctcacaaaaacatgtgttgtatgaaatcaaggtttaaggcatgtagggctgtgcaggatgtgccttgttaaccaaatgtttgcaagcagtatacttggtaaaagtcatcaccattctcttgtctcaataaaccaggggcacaatgcactgtggaaagccgcagggacctctgcccttgaaagctgggtattattcaaagtttccccccatgtgatagtctgaaatatggcctcgtgggatgagaaaggcctgacggtcccctagcccgacacccataaaaggtctgtgctgaggtggattagtcaaagaggaaagactcttgcatttgagatagaggaaggccactgtctcctgcctgcccctgggaactgaatgtctcggtataaaacacgattgtacatttgttcaattctgagatgggagaaaaaccgccctatggtgggaggtgagacatgtttacagcaatactgccttgatattctttactccactgagatgtttgggtggagagaaacataaatctggcttacatgcacgttcagtcatagtaccttcccttgaacttcattatgacatagattctattgctcacatgtttgttgctgaccttcttattatcaccctgccctcctactacattcctttttgctgaaataataaagatagtattcaataaaaactgagggaactcagagaccgg

SEQ ID NO: 378348 - DNA, 287 bp, Homo sapiens
tgatagatcaaaggaaaatgatccaacctaaacaacagagagataaactatgaaaaaattgaacaccaccttagaaacttataggcagtaacaaaacattgaacatgtagaatcccagaagagaaggaagcttgtgatactgaaaaaacatttgatgaaataaggactgaaatgttccaagttttatatacacataagcctacagactcaataatgtcaaagaacccccaataggataaacccaaagaaatcaatgcccagacacattatagtcaaatctgaaatct

SEQ ID NO: 378349 - DNA, 452 bp, Homo sapiens
aaaaatttattttttgccttttatttgagatgaggtagaaggctttcacgtattatggattcacattctttgttgaatatatgcattatgaatattttctcctagtttgtgacttggctattaattttcttaagcccttcaatgagcaggcatttttaaattttgggaggctaacttaacttttttattcttttataatcattgctttttgtgtcttacctaaaaaaatctttgcctgtaccaagatattcttgtatgttttcttctacaaatttcatagttttaacttttacatgtaggattatgatgtatctgaaattaatttttgtgtacagtatgaagtaaaggttaaaatttatttcatttttatatatttacacagttgttacagaaagttgcagaaaatatttacttttcctcatcaaattgctgtgaatgacctttattgaaca

SEQ ID NO: 378350 - DNA, 1365 bp, Homo sapiens
gcaacctaagtagctggaactagaggcatgcacattatgccccactagtttttaaattttttgtagagacagagtctcattatgttgcccttgctagtctccaactcctgggctcaagcaatctttctgcctcggcctcccaaagggctgggattataggcatgagctgggcaccaggccacaaaattgattttagaaaaattaaaatagtgtgcttgtgaatatgggaaaccagcactcattggtggttacatcagtttggagacccctttggatagcagtttttcaatgtgtattaagaaccctcaaagagaacaaaaaacacctaaacagcctttaactagtaacttttttcattctgagaacttgattccaacaagaaaaatccaaaagaggaaaaaggctttaagaaaagacatctttagagacactgttggtaatgttaaaatgtccgaataacccaaatgctcagcaactagagaacagtaacatgaattgcggtcgatgttctccagcctttgaagctagaggctaagaacaccacaagagaacacaaatatgctgaggaggcaacgctaagtgaataccggcgggtggcagactgcagacactgtcaacccggcatgtgccagacacaggagactttccaataggaagatagaaatgcatgataaacacagatctgatttctaacataaaaatatacctctatcttctccaaagaattctctttcaaatatatgttagtataacctttcttagtacttaagagttacttctaggaatctccctgaaggacatgatttctcattcaaacagatttaggtgcagggatgcttattacagtctcattcattatggttaaacaactggaaatgcctagatatccaggaataggggaatgataaagtatgcttgagctatacagtaagacattatatgactattgaaaagtttcttgaagaattttaactggggaaatgatcatgacataatgttaaaaaattactactacacgaaaggtatatcaaatatctaagtatgttatttatatacagaaacatggtgaaaatataccacagtggtagaagtttaggttgtgaagacatttttttccttatacatttctgaattgttccaagttaaaacaaaacaaaacacaaaacaaaaaaaccccacatactattttttttttttttttaaagctctgtcacccaggctggagtgcagtggcatgatcaatgctcacagcaaccctaaactcctgggttcaggcaatcctcctgcctcagcctcctgagtagctaggactacagttgcatgccaccatgcctggctaattttcaaaattttttgtagagaggg

SEQ ID NO: 378351 - DNA, 514 bp, Homo sapiens
agcgctcagctcctgcgccccgaccccgccatggccccccggcccctcctgctgctgctgctgctcctcgggggctccgccgcgcgccccgcgccccccagggcccggcgacactcagacgggacgttcaccagcgagctcagccgcctgcgggagggcgcgcggctccagcggctgctacagggcctggtggggaagcgcagcgagcaggacgcagagaacagcatggcctggaccaggctcagcgcgggtctgctctgcccgtcagggtccaacatgcccatcctgcaggcctggatgcccctggacgggacctggtctccctggctgccccctgggcctatggtttcagaaccagctggcgctgctgcagaaggaaccttgcggcccagatgaggaaggaaccccctcaccacctgcccggcccaggagcgcagctgcatttggggtggggggcaggatgggggagagggggaggggtggtacttggcaccaataaaggaggaatcagacc

SEQ ID NO: 378352 - DNA, 3303 bp, Homo sapiens
cgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgccggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgacgggtgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378353 - DNA, 771 bp, Homo sapiens
tgcggccgccccaacatcagaatggtaacaccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378354 - DNA, 532 bp, Homo sapiens
aagactgaatcaggagtgattttcaaatgtagagaaaactccagataatgctgtttgcttccggccgctgtaaatcataggtgaaaaccagtagcaagtgctcactcagtgcctcccagaagcggtctgcgggtctcagctgggctgggggcagttttcattgggcaaggcttgggcttagcttcgaagcaggggctgggagaggatggatgggggtgtgagagcagaagaaagacctggctttgcagtgaggcagtcccaagttcaaatctgagctcaccactgacccgtcgtgtgatgggcgccaggtgttaggagactggaactgggtatgtgtgtggcattcggccggccatagtagctgctcagtaaacagaaactgtttctcatcctcatcctcatcctcatgcctgcaaactgtaaaccgtcctacttaacaatgaaagtagaaaagtgtttcaatgtgacaggaaagagtgaagacacagaagcttggaaatgatgatgtgttaaagaatcactttaaacaaaa

SEQ ID NO: 378355 - DNA, 3180 bp, Homo sapiens
cgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgccggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgacgggtgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378356 - DNA, 2815 bp, Homo sapiens
tgcgggcggggacaagcctggctccgcagaaggggagctgccgccgccgcggtggcactgcctgatgctcggcccagtgtgccggtgccccgctgggtgacagtggactcccagggcgcagcaggagcaggtgacagactgttggctgaaggtgagggtgtccaccctcgcaggcacacgttccagggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgccggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgacgggtgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378357 - DNA, 1418 bp, Homo sapiens
ctgctctgggacatgttaatgaacttggtccacagcagcagatacctttgtaggagtcaagagcagaagattctggctccagctccaccactgggtgctgtgtgtccctggcagggtcgctgtcctctgagctcagttctttcactgcagagagggtgtcaggaaccgccaggaggccgagcacgctgagggccaccccatcctcaatgcaatcctgcccctggattgcttggcggcagcaaactgcccaatggtgtcccttgctgcgtggctaactggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378358 - DNA, 3103 bp, Homo sapiens
tgcgggcggggacaagcctggctccgcagaaggggagctgccgccgccgcggtggcactgcctgatgctcggcccagtgtgccggtgccccgctgggtgacagtggactcccagggcgcagcaggagcaggtgacagactgttggctgaaggtgagggtgtccaccctcgcaggcacacgttccagggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgccggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgacgggtgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagaaa

SEQ ID NO: 378359 - DNA, 754 bp, Homo sapiens
cgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagacagaagaaagacctggctttgcagtgaggcagtcccaagttcaaatctgagctcaccactgacccgtcgtgtgatgggcgccaggtgttaggagactggaactgggtatgtgtgtggcattcggccggccatagtagctgctcagtaaacagaaactgtttctcatcctcatcctcatcctcatgcctgcaaactgtaaaccgtcctacttaacaatgaaagtagaaaagtgtttcaatgtgacaggaaagagtgaagacacagaagcttggaaatgatgatgtgttaaagaatcactttaaacaaaa

SEQ ID NO: 378360 - DNA, 352 bp, Homo sapiens
ttgacagaaaaatatattatttactttgcagaggaacaaagcagtcagagaaaattgtggaggactagtaactcaagaacagatgtagatttaaacaagtgacaagtgcagcaaaactctttattaggattttaatgatcttaattttgcaatgatctgtcataatttcaacaagaaagcttaaagtcaaaagaagataaattattaaaaataggcttctagtaactactgtaagaaaacaacagcaatatgaagagataattatatacaatatagccgaaaagttggaagactgtgtgtctagtaatagggcatttgttatatgatacattataatcatatagtagtcacc

SEQ ID NO: 378361 - DNA, 368 bp, Homo sapiens
ttttgcaaatataacaataatagtaataacacaattttgtcatttaaaaaattacccattcatttttcaaacttgactgttagtggaggggtatatgtgtgtctgtgtttccacttatgtaatggctgtctcattatttaaattaatttataattatttttcagtgtacagagtgattagcggcttgtaatgctgttacaatgtagcattgtaatgtaagatgaagaaaaattaggatttaggtgggatttttaaaaatttatcaattcagctactttttaaaagaagtcctattccaattggacctttaaaatttttattttggtaatatttcaacttaagatgtattaaaactagcaattctgtgg

SEQ ID NO: 378362 - DNA, 368 bp, Homo sapiens
cagttcaagcaatttgtatcctgatttacatttcagcattgtttatgaggttgaagaagcataataccacctttgttttggcggggggtaattgaatttaaggttgcctggcttagagatgtgtgttagactttagtctccagcaaataaaacccttagtaggtccaagtattaaagtcagtcttaaaacttgaattggccatattgtacagggctggtatgaagttttttcttttctttcttcctaccacaattaattgtatacatggatttaacaattgtgtaatctattgtatattaatgcagttactttaagcgaagccttacgagtttacttttttcaatggttgttatacatcttattgtgt

SEQ ID NO: 378363 - DNA, 258 bp, Homo sapiens
ttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattg

SEQ ID NO: 378364 - DNA, 2707 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378365 - DNA, 2611 bp, Homo sapiens
  misc_feature (383)..(383): n is a, c, g, or t
  misc_feature (2425)..(2425): n is a, c, g, or t
aaaaattagccaggcatggtggtagcatgcacctgtagtcccagctccttgggaggctgagatgggaggatctcttgagcccaggaggttgaggcttcaaggagctgtgatagtgccactatactccagcctgggtgatggggcaagatcgtgtcttgaaaaaagaaaggaaaatatttttacagatttatataatcttttttggggacacattttttgggactttgatctggatttgagtgtagtcacttaattagtatatcgttttctaatataaaactattcgaatgactgattgaaacagaaagggaaccaaagggaggaggatataagatagggaacaaggaaaccatatttgggggagctttaaaaggtgacatggntaagagaatggggttttatgaaagaaaggttcttaacaagtaatcattgttcgcaaagctatagttatcaaaacaccctttgctgagaacttgctctctgtccacagctgtccccgaagaagacctgggaaggcttcattgggggcttctttgctactgtggtgtttggccttctggtaggtggtggctttcagctgtgtaagggattgggtggacagaggcctcataccaccttccaaggcctgtccagagctggagagtgtctttggaggccaggactgtcctgctgaatggcaaccttgccctgaagagggccactggccatgccagccatccaccagctttcaggcagggtgctagcagttggagagcaccttctatgccctctcgcgcccaggcatggtgacatcagcaggtagccttcttgtcaggcatttgatgttccaaggtcagggtgagtgcacccaagggaagatgagatacacagcttttctcctatgtgtgccttgcccagaggtgggtgattttcctgccctttccagagcaccattctctgcttctgacccttgggccagtcctccttcttcagcactgtctggctgcccttcagtgctcaccgcccagctttgttgctttccagccttgttcctcctgagatctgcctctcactgtgccccttccccatggcctctctccagttatcactgacttcagagatcttgaggaaagtggtcctagctccccaaatggggagagtcttcttgtagttctttgccccagtcccttcaggttttcccggattctttcggggcctgggtgtttgggttcctgtatgtaaccttggtgggtcatgagccttttttttttttttaattgaggtaaaatatgtatggtaaaacatgaacctctgagcacatagctcgcagttagcagggtactaggcaccctcaggaacatggccaaaccaggtgcctgtgtctgggctggatggttggaacttacttccttgccggtctctctgttattcctcctcagctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctgggtatgtgccactcacagggggtgagcggcctccatggacagtggctacaaagagagatccccctccatcacctgccctctgaaaaaagctagcttcctccttcccaaagctgtaagccccaggatgaaggagaattgctcacgccaggtcagggtatgggcaggacagctttcccccaacatcagattgtttagaccagtggttttcaaagtgtgttctgtggatccctggagggccctgggatccttttagttgcgggggtagggtgggggggtctgtgaggtcacaactgtttcataattagactatgacattattttcctttttcaatgtgttgacatttgctgtgatacggcgcaaaagcagcagtggttaaaactgcgttaaggcagtgggttcctcatgccacacactcacagtacaaacaggccagttctaatgaatgtctatgaaatagtaaagttactaattttgttaaatcttgacctttgtacacacacctttttaacactctctactgaaatggaaagtatgtgtaaaacatttctgctaagtactgtagtacagtgcttgcctaaagggaaagcatgtgtgcagttgtttgagttgtgagctaaattagctgctttttttttagaaaagaaagtaaattttacttggaaagaaccaacaaattataatttttcagacttgggtatttggcagacatttttcttgaaaaggatgaagtgagcctatcactttaaagaaaacaactgaggctaggcacagtggctcacacctgaaatcccagcactttggaaggccgaggcaggcagatctcttgaggtcaggagttccagaccagcctgggnaacatggcgaaaccccgtctttactaaaaatacaaaaaaatatagctggggatggtggcgtgtgcctgtaatcccagctaccagctactcaggaggttgagttgcttgaacccaggaggcggaggatgcagtgagccaagatcgcaccactgcactccagcctgggtgacagagtgagactgtctc

SEQ ID NO: 378366 - DNA, 924 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtaagtgccatttcacactattttagttttcccttcagtttttgctgcaggcccggttgtcttaagtgcgaggtgttgggttggttgtgggaattgacgggggtccaggcttctcagaaaacctctgccatagaacatctgtgacttcccacttctcagtagccacctggagggtcattggtgtaggctggttgtttatggttgaagatgtctcagtgtcttttcttttaaaaaactgactttattgcctgtgatcccagcactttgtgaggctgaggtgggcggatcacgaggtcaggagtttgagaccagcctgaccaacatggtgaaaccctgtctctactaaaaatacaaaaattagccacgcgtggtg

SEQ ID NO: 378367 - DNA, 3308 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagataattggagggtccaccatcactttgtcacctgctcaatggttggctggagctgaggatcatcggttcccaccaatccctgttgccttacaccaggctcacggcttcccctaatgcagcctgtaactttttgatgactggacgcaacggacattagggagacacccagaaggaagaaagcacaagatttggtgacaggatgtcaacagagcagttacactaggaggaatgtttttggtgaaagataatgagatcatgggttttttttaaacaactttcgtgttattgcagttgacagtggactatccaaagagaactgttcctaccgatttttagaacatatattttggccaggcacagtgctgctcgcctgtaatcctagcttctagggaggctgaggcaggaggatcgcttgagcccaggagtttgagaccctgtctcaaaaaacaaaaacaaaaacatattttggagaacatttagggctggggctgaggatttagcagtcgcttgcagagacaagatactttgaagtctctaatttttcatttggctatcctggttcagcctgaaagaattctgacttaccttgtactactagttggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378368 - DNA, 2691 bp, Homo sapiens
tggacacttcaatgtgtttaaatacttttctgttacaaagattcaatacaggctgggtgcagtggtacacggctatatcccagtgctttggaggctgaggcaggaggatcgcttgagcccaggagtttgagaccctgtctcaaaaaacaaaaacaaaaacatattttggagaacatttagggctggggctgaggatttagcagtcgcttgcagagacaagatactttgaagtctctaatttttcatttggctatcctggttcagcctgaaagaattctgacttaccttgtactactagttggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378369 - DNA, 2742 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggtgagaattgggagttggattttcccttttattttgttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378370 - DNA, 2375 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378371 - DNA, 2605 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggtgagaattgggagttggattttcccttttattttgttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378372 - DNA, 1511 bp, Homo sapiens
tgggcatgtatgcacctaaacttttacttcatttactcttctcagaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378373 - DNA, 2416 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagataattggagggtccaccatcactttgtcacctgctcaatggttggctggagctgaggatcatcggttcccaccaatccctgttgccttacaccaggctcacggcttcccctaatgcagcctgtaactttttgatgactggacgcaacggacattagggagacacccagaaggaagaaagcacaagatttggtgacaggatgtcaacagagcagttacactaggaggaatgtttttggtgaaagataatgagatcatgggttttttttaaacaactttcgtgttattgcagttgacagtggactatccaaagagaactgttcctaccgatttttagaacatatattttggccaggcacagtgctgctcgcctgtaatcctagcttctagggaggctgaggcaggaggatcgcttgagcccaggagtttgagaccctgtctcaaaaaacaaaaacaaaaacatattttggagaacatttagggctggggctgaggatttagcagtcgcttgcagagacaagatactttgaagtctctaatttttcatttggctatcctggttcagcctgaaagaattctgacttaccttgtactactagttggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378374 - DNA, 1515 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagataattggagggtccaccatcactttgtcacctgctcaatggttggctggagctgaggatcatcggttcccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378375 - DNA, 308 bp, Homo sapiens
ttcttcactaaaaccacaaagtcctgcttaaaactatggaaaacctaacctgattagagccttgactattttgaagattaaatgcacactttttatataatgtgaccagtttaaatgtagtttgtattgtactgggggacctttcgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtgga

SEQ ID NO: 378376 - DNA, 2832 bp, Homo sapiens
  misc_feature (2725)..(2730): n is a, c, g, or t
  misc_feature (2741)..(2742): n is a, c, g, or t
  misc_feature (2752)..(2752): n is a, c, g, or t
  misc_feature (2829)..(2829): n is a, c, g, or t
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataaaaaaaaaaaaaaaaaaannnnnnacggggggggnncccccccccntttttttttttttaaaaaaaaaaaggggggggggggggggggggggggggggggggggggggggggggggggggggnggg

SEQ ID NO: 378377 - DNA, 2664 bp, Homo sapiens
ggggacgcgcgcagaggggtcgtcttgttctctgaccctttgtcgcagccgacggcggccccgggcccgggtagcgcgaagggccctcgggtgcccggccttcgcggcgcgcgcgtcaggggtcggcgggtcggggtcccggctcagggtctgactgaagtggctcccccggggcgcaggaaggagcttctcgggagtggcgcacggcctcctgcctcgctgggctggctgcggggactcccctctcccccaactccgtgaggccttcctggaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378378 - DNA, 2727 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctgggtatgtgccactcacaggggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378379 - DNA, 2570 bp, Homo sapiens
cccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378380 - DNA, 3037 bp, Homo sapiens
  misc_feature (383)..(383): n is a, c, g, or t
aaaaattagccaggcatggtggtagcatgcacctgtagtcccagctccttgggaggctgagatgggaggatctcttgagcccaggaggttgaggcttcaaggagctgtgatagtgccactatactccagcctgggtgatggggcaagatcgtgtcttgaaaaaagaaaggaaaatatttttacagatttatataatcttttttggggacacattttttgggactttgatctggatttgagtgtagtcacttaattagtatatcgttttctaatataaaactattcgaatgactgattgaaacagaaagggaaccaaagggaggaggatataagatagggaacaaggaaaccatatttgggggagctttaaaaggtgacatggntaagagaatggggttttatgaaagaaaggttcttaacaagtaatcattgttcgcaaagctatagttatcaaaacaccctttgctgagaacttgctctctgtccacagctgtccccgaagaagacctgggaaggcttcattgggggcttctttgctactgtggtgtttggccttctggtaggtggtggctttcagctgtgtaagggattgggtggacagaggcctcataccaccttccaaggcctgtccagagctggagagtgtctttggaggccaggactgtcctgctgaatggcaaccttgccctgaagagggccactggccatgccagccatccaccagctttcaggcagggtgctagcagttggagagcaccttctatgccctctcgcgcccaggcatggtgacatcagcaggtagccttcttgtcaggcatttgatgttccaaggtcagggtgagtgcacccaagggaagatgagatacacagcttttctcctatgtgtgccttgcccagaggtgggtgattttcctgccctttccagagcaccattctctgcttctgacccttgggccagtcctccttcttcagcactgtctggctgcccttcagtgctcaccgcccagctttgttgctttccagccttgttcctcctgagatctgcctctcactgtgccccttccccatggcctctctccagttatcactgacttcagagatcttgaggaaagtggtcctagctccccaaatggggagagtcttcttgtagttctttgccccagtcccttcaggttttcccggattctttcggggcctgggtgtttgggttcctgtatgtaaccttggtgggtcatgagccttttttttttttttaattgaggtaaaatatgtatggtaaaacatgaacctctgagcacatagctcgcagttagcagggtactaggcaccctcaggaacatggccaaaccaggtgcctgtgtctgggctggatggttggaacttacttccttgccggtctctctgttattcctcctcagctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataa

SEQ ID NO: 378381 - DNA, 394 bp, Homo sapiens
agatgaggagcctgggagagcaaagcagtgtgagttctccaaattgcacagcttatgagtgcccttcagggttctgtaagttggccctggaccagggaccaggaatggtatttcttctcatctgccttaggaagattgaatggtatgcgaaaaaagtcctggttgagaagttgaggcacaggttttgctccagatttgctgataactgcatgtgagattttagaaacctcaaaaaaatcgacccttccgaaaaccaatgctctgcctttcgttttcaaggacattaaaatattgctaacttgaatacacaagaagaaagagggtggtataagtaacagctgatctcactcccttttaaatataaatcatttcaaatggaatgatgtcctttgca

SEQ ID NO: 378382 - DNA, 1406 bp, Homo sapiens
aacaatagacaaccgtggctttgacaatgccttccctcaaccccctttctgctcctgctgtgacacttgcattcaagagcaaggacgtctgccatccgatgcatggacaatggaatgaggaatacaaggcagcggggaagaaaggaaatcagatgaattctgagctaagatggcagggttctcaccttttccattttggggaatttttttgttttttgggtttttttttttttttttgccaaaaataaaaagtctggatggagtcttcccgcagagaagaaataaaaagagtgtttgaattgttggatggttctgaaggcttctgaatttgcaaacgaattttagaactatttgcagaggtctacttgctgccagtcatctctctctctctctctttctcttctgttttatgtcctgctatctccatcatgcctctgttactatgaagactttctgcctgtgtaagtaagtgagagtgtgcattccttaatgtttgaatcaagacacacgtctgcatgcatttctaatctaagaagcctatagcagttactacaactatcaattagtcagcaatagctgagaacttcaacgcctctgaaggaacaaaggtggaaagacaggcagatactccagcatctggatcatgcaacttgctggctacaaataatggcaccttctctggcttttatctgtgtttagtcctcaaatctatgtaacattatgggttattaatgtatccagccacataattagatatggagcatctaagacatatatgtttctttggcattattgggaataaaatgcattaagctgaactaaaaggaattgcctgctgacaaaaaagagtttatcgtatatgtgatctacgttccattttaatcaactcccactagaactgaaattaactatacggtagagttctttgttcatttcagtggtttttatgaaagaagctaagaaaatagtgattaaaaaaggaaagctaaatatttagctgtagaaaagcatataagaagattaattttcctccataaatgaaatcattttggtttaaactcaagcctggattttggttaatgttgagtgggtttgtgtgggggggctgtgtgtgtttagttgcaagtgttgtgagcaccgtcttacactgcatatgtctgtgttaacttgtattgaatatattctgggctaaccacctgaaacaaaataaagacttcttttatctcattttacagaaacctcaaaaaaatcgacccttccgaaaaccaatgctctgcctttcgttttcaaggacattaaaatattgctaacttgaatacacaagaagaaagagggtggtataagtaacagctgatctcactcccttttaaatataaatcatttcaaatggaatgatgtcctttgca

SEQ ID NO: 378383 - DNA, 1181 bp, Homo sapiens
agatgaggagcctgggagagcaaagcagtgtgagttctccaaattgcacagcttatgagtgcccttcagggttctgtaagttggccctggaccagggaccaggaatggtatttcttctcatctgccttaggaagattgaatggtatgcgaaaaaagtcctggttgagaagttgaggcacaggttttgctccagatttgctgataactgcatgtgagattttagactttctgcctgtgtaagtaagtgagagtgtgcattccttaatgtttgaatcaagacacacgtctgcatgcatttctaatctaagaagcctatagcagttactacaactatcaattagtcagcaatagctgagaacttcaacgcctctgaaggaacaaaggtggaaagacaggcagatactccagcatctggatcatgcaacttgctggctacaaataatggcaccttctctggcttttatctgtgtttagtcctcaaatctatgtaacattatgggttattaatgtatccagccacataattagatatggagcatctaagacatatatgtttctttggcattattgggaataaaatgcattaagctgaactaaaaggaattgcctgctgacaaaaaagagtttatcgtatatgtgatctacgttccattttaatcaactcccactagaactgaaattaactatacggtagagttctttgttcatttcagtggtttttatgaaagaagctaagaaaatagtgattaaaaaaggaaagctaaatatttagctgtagaaaagcatataagaagattaattttcctccataaatgaaatcattttggtttaaactcaagcctggattttggttaatgttgagtgggtttgtgtgggggggctgtgtgtgtttagttgcaagtgttgtgagcaccgtcttacactgcatatgtctgtgttaacttgtattgaatatattctgggctaaccacctgaaacaaaataaagacttcttttatctcattttacagaaacctcaaaaaaatcgacccttccgaaaaccaatgctctgcctttcgttttcaaggacattaaaatattgctaacttgaatacacaagaagaaagagggtggtataagtaacagctgatctcactcccttttaaatataaatcatttcaaatggaatgatgtcctttgca

SEQ ID NO: 378384 - DNA, 1017 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaagacagaagtatttaaaggcattcgctttccttggtaaggggatgactggtgtttccatcatgagcgaaacaagctaacatgactaacaccctttattccatccagccctctctcctaggaggcctgccccggtaaccggctttttggcccaatggggcattatcgagaattcccaaaaacgattagcctcattatcccacattatagcaccattacctcttaactatatttactagctaataattccactaataattaatcccattttacacgttacatactgccgctgactttaaccaccaatttcc

SEQ ID NO: 378385 - DNA, 3207 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378386 - DNA, 3288 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttcttggaaaaaaacttttggggatttttttttaatggcccaggggaaaacttttttttaacccccttttttttttgcccccaaatttttttaaaaaaaaattttttttccccccccatttttttttaagggggccccccctttttttttttccccccttttttttaaacacccgttctaaataaaattttaaacctttaaattttccaatttttttaaaaaaatattcccccgggggggtcttcaaaaatttccctatgtgttttaaaaaaaaactctccaaaaaattttggggggaaaacatttaacccctttttaagagaaaattgccttatttgtgaaacacggtgttttctccactggggaaaaaggggcccctt

SEQ ID NO: 378387 - DNA, 3138 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378388 - DNA, 3105 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378389 - DNA, 2816 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378390 - DNA, 2994 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378391 - DNA, 2852 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgggattcctctcgttgagcgacagtagcatttgcccacctggcacctgagatccctgtttactaaaccttagaaaagctgccaaa

SEQ ID NO: 378392 - DNA, 2261 bp, Homo sapiens
aggcatcagcagcttcctcctcagagtccaggtctgccgctgccttcgtgcccacggtcttcactccctgcgccgggaccaacaatgccctggctcctgagggctgcttttgacctgtgcggggagcagccccaacttggggtggggtcttacaggcttctggacctgccttttcctgacaattcaggtcagagtctcaagtcccctgggaggggccccaagcagctgtgaggcctgggtgctcggagcccactgaccgctagccttgtgcttgtccccagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378393 - DNA, 1893 bp, Homo sapiens
ggagtgcggagccagcgggtgcctgtagtgggtggaattggggtctgcacttgcccctccgcccccaggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378394 - DNA, 2635 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcggggctgagccccttgagctgcttcagtgaatgtacagtgcccggcacgagctgaacctcatgtgttccactcccaataaaaggttgacaggg

SEQ ID NO: 378395 - DNA, 1527 bp, Homo sapiens
tctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378396 - DNA, 1773 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaacaacttgacaatgtttgagacccaaggcttgggggcccttccttgggggggacggggcccacatttcttttccatttcacgatcgagtgcccttgaaacaggacaagacacagttccaagccttcattagtgggccggaggcccatttcccctgtggttacaccccccggggttctcccaacagggcgccaaaggggtctttggggcgtctcatccccctgttg

SEQ ID NO: 378397 - DNA, 2328 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcaggtacggggagggttgctgcctgttggtttctgcgggtgagagtggtggcctcctctcccccttgcctttcccacatcccatgggacgttccacgggaggctcctgacctctctttgaagagcctgtacctgccctggaagtgaaggtggtttggctgcaggggcctgtgtctgtgctgagagccagctccttccctctgcctctgttcaacattcccctgactgtcaccagaagcttcctcctgagggctgatttcctaacaggcctgcagggaggaaggactggaccagcttggggctgagatgcagggctgggactgggagcccaggcactctgtgctgtgctgggcgggaatagagggagggtctgcttccacccatcctgctcgaggctatggagcccgctggccctgggcaggctctagtgctctgcacccttgcagtttcttctgagagaaatgttcaaacgccattcccagactgggcactcggcatgaggggtgcatgccttcgcgaaccgttcaggtccttccaagtcaatcacccactggtgcgtgtaccggggggccgcatcaggcacagcaggactgcacagctgtgtcccacaggaggagccagacagttatttcatcgggaaagccttccaagagaaataacacggggcggggatctgagagggcgatcgcagctgtaactaggacagccaaggacggcctcgtggggtaacatgggatctaagacaggaggaggtttcaagaaactgcgcagatctgaagcagcagcaccccaggccgcacaagcagcacacaccggggccctctgtcagctgctgtgtttaatgaacgaggaggaggtggtgtggcttggtgggggacaccaggaggaaatgagccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggg

SEQ ID NO: 378398 - DNA, 1541 bp, Homo sapiens
  misc_feature (1477)..(1477): n is a, c, g, or t
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaaggagcagctggtggtgggggccttcgagatcgaaacaagtacgtgtgtcggaccctggaaaacacggcgacaagaagccctttcactctgacctcacttacgtagcctggtctccggatcggttgccagaagcaacgttgagccatcgaaatggaacttggcacctggcttgggcatttatatcatctacagaaagtaccntatggcaccgacaccagattgatgtacactccgacatacgcacacacgtcatcagttacaacgc

SEQ ID NO: 378399 - DNA, 1320 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagggggctgagccccttgagctgcttcagtgaatgtacagtgcccggcacgagctgaacctcatgtgttccactcccaataaaaggttgacaggg

SEQ ID NO: 378400 - DNA, 685 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcatgagctgctgtaaactatttgtggctgtgctgcttgagtgacgtctctgtcgtgtgggtgccaagtgcttgtgtagaaactgtgttggggctgagccccttgagctgcttcagtgaatgtacagtgcccggcacgagctgaacctcatgtgttccactcccaataaaaggttgacaggg

SEQ ID NO: 378401 - DNA, 293 bp, Homo sapiens
agaagtaatgttctggccaagacattaggtattatactcatcttgttctgatgaacaaagagtcagaatttagacaaggaatagctgaagggcccctgccacttggggattggtctgtgttagtgtctgtctttaaaaagtgtggctagtcatgattgtatgtgttctcctgtgtgtattcatagttgtacccttttcaacatgttttccccttagaaactcccacgttaacccacgaaaccttcaaagcactgaagccaggtctttctgcctatgctgatgatgttgaaaag

SEQ ID NO: 378402 - DNA, 2753 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggg

SEQ ID NO: 378403 - DNA, 337 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaagggggctgagccccttgagctgcttcagtgaatgtacagtgcccggcacgagctgaacctcatgtgttccactcccaataaaaggttgacaggg

SEQ ID NO: 378404 - DNA, 3250 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378405 - DNA, 3148 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378406 - DNA, 3151 bp, Homo sapiens
atggctttactggttagattactggtcaggtcggtcgtacacggtctgaaccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378407 - DNA, 2672 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378408 - DNA, 2051 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcaacctcacagtgctcctgcagactgggtgttgtgtctcccacagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378409 - DNA, 2664 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggcactgtacattcactgaagcagcttcaaggctcagccccgacactgacgccacactgagcaggatgcacggcccggggctcacactgtccatgtc

SEQ ID NO: 378410 - DNA, 1498 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaagaagagagggggggcgcgcgccgccagaaagatattcccgccgcgagggggggcccgccgcagctcggcacgcgcggcacccacgcatttcttgttgttagacacagaggcggcgcctccaatagaggagggacgcctctcttataataaagccgaggacgcgcgcacggggcgcgccgcgcggtatataacagaacgagcgcgctgcgagagcgcgaggcgacaaaagcgcgtgccgacacgcgggagaccacacttgtggggagggagagagcgaccaccccatctatctgtcgggggggagggagcgacacaaaactatgtgtgggcgggcgaacaacctctctctctccatagaaagagaatttattaagacgcgcctctcgaggggg

SEQ ID NO: 378411 - DNA, 2863 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcaggtacggggagggttgctgcctgttggtttctgcgggtgagagtggtggcctcctctcccccttgcctttcccacatcccatgggacgttccacgggaggctcctgacctctctttgaagagcctgtacctgccctggaagtgaaggtggtttggctgcaggggcctgtgtctgtgctgagagccagctccttccctctgcctctgttcaacattcccctgactgtcaccagaagcttcctcctgagggctgatttcctaacaggcctgcagggaggaaggactggaccagcttggggctgagatgcagggctgggactgggagcccaggcactctgtgctgtgctgggcgggaatagagggagggtctgcttccacccatcctgctcgaggctatggagcccgctggccctgggcaggctctagtgctctgcacccttgcagtttcttctgagagaaatgttcaaacgccattcccagactgggcactcggcatgaggggtgcatgccttcgcgaaccgttcaggtccttccaagtcaatcacccactggtgcgtgtaccggggggccgcatcaggcacagcaggactgcacagctgtgtcccacaggaggagccagacagttatttcatcgggaaagccttccaagagaaataacacggggcggggatctgagagggcgatcgcagctgtaactaggacagccaaggacggcctcgtggggtaacatgggatctaagacaggaggaggtttcaagaaactgcgcagatctgaagcagcagcaccccaggccgcacaagcagcacacaccggggccctctgtcagctgctgtgtttaatgaacgaggaggaggtggtgtggcttggtgggggacaccaggaggaaatgagccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttcttggaaaaaaacttttggggatttttttttaatggcccaggggaaaacttttttttaacccccttttttttttgcccccaaatttttttaaaaaaaaattttttttccccccccatttttttttaagggggccccccctttttttttttccccccttttttttaaacacccgttctaaataaaattttaaacctttaaattttccaatttttttaaaaaaatattcccccgggggggtcttcaaaaatttccctatgtgttttaaaaaaaaactctccaaaaaattttggggggaaaacatttaacccctttttaagagaaaattgccttatttgtgaaacacggtgttttctccactggggaaaaaggggcccctt

SEQ ID NO: 378412 - DNA, 2142 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcaggtacggggagggttgctgcctgttggtttctgcgggtgagagtggtggcctcctctcccccttgcctttcccacatcccatgggacgttccacgggaggctcctgacctctctttgaagagcctgtacctgccctggaagtgaaggtggtttggctgcaggggcctgtgtctgtgctgagagccagctccttccctctgcctctgttcaacattcccctgactgtcaccagaagcttcctcctgagggctgatttcctaacaggcctgcagggaggaaggactggaccagcttggggctgagatgcagggctgggactgggagcccaggcactctgtgctgtgctgggcgggaatagagggagggtctgcttccacccatcctgctcgaggctatggagcccgctggccctgggcaggctctagtgctctgcacccttgcagtttcttctgagagaaatgttcaaacgccattcccagactgggcactcggcatgaggggtgcatgccttcgcgaaccgttcaggtccttccaagtcaatcacccactggtgcgtgtaccggggggccgcatcaggcacagcaggactgcacagctgtgtcccacaggaggagccagacagttatttcatcgggaaagccttccaagagaaataacacggggcggggatctgagagggcgatcgcagctgtaactaggacagccaaggacggcctcgtggggtaacatgggatctaagacaggaggaggtttcaagaaactgcgcagatctgaagcagcagcaccccgggccgtgcatcctgctcagtgtggcgtcagtgtcggggctgagccccttgagctgcttcagtgaatgtacagtgcccggcacgagctgaacctcatgtgttccactcccaataaaaggttgacaggg

SEQ ID NO: 378413 - DNA, 1205 bp, Homo sapiens
acgtgcatggtgcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggtgacagagcaagactgagactccatctcaaaaaatcaaggatgatgagagaaatgaggcagttccaggaaggagctctcaggagtgtgcaggtcgcagcc

SEQ ID NO: 378414 - DNA, 445 bp, Homo sapiens
tgcctatgctgatgatgttgaaaaggtaaggatcctctcccgtgtctccctgttcaactgcagaatgtgttcaagccagttcttttcctttgaatgtggtaggctgtcttcacaaaggaagggggctttgacagtgctgcctgggcatttcatgccatttgggatggtcagaagagagaaggtgtgcagcgcgcgagcccagaggagaacgcgcccccacccggccccatcctctgactccaccgtgccagcgctcacttctccaacgtgggggtcccgaggtcttggtacaggtcagaagcacaaatcctgcaaacttacaaaaatcattatttgatagtttgcttattcaaatttttacgctaatttagtcttgtgaattttgcataatacatttttaattttttgttgtggtttctgatcgaagatagcaaacattgactga

SEQ ID NO: 378415 - DNA, 408 bp, Homo sapiens
caacgaattgcagtgcttacgtgcatggcggtttgagagaaaacctttccaatcttctgttccctgccctgtcacttagcaagtgatttcttctcggcaagctctcctacctgatctcctgctgtgttgggatcatcctctgcaatgtccctgcactaagaggagaaggtgaaaatcagcctgcaggttcaaattaattgcacttctcagttatgctgtgagttagccagtgctttaaataatgacattctaaacttctagtttaaacataattggaaagagaaagttgacattaaagtaataagtgagagtaaacttaagtgaaggagaacagtgtaaaacattcatatgcaaatactcaaatactcttgataaaattattcataggcagttgactattttattaaa

SEQ ID NO: 378416 - DNA, 3470 bp, Homo sapiens
  misc_feature (3079)..(3079): n is a, c, g, or t
acggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccccccccgccggacaggccgttgcccgccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtnggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtc

SEQ ID NO: 378417 - DNA, 3292 bp, Homo sapiens
  misc_feature (2901)..(2901): n is a, c, g, or t
acggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccccccccgccggacaggccgttgcccgccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtnggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtc

SEQ ID NO: 378418 - DNA, 2630 bp, Homo sapiens
acggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccccccccgccggacaggccgttgcccgccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctggggccaacttgccccggttgagacggtttctccggttttggtcctccgctggggcgcgggttctggggggggcccaacgggaggccctcccggggccgggcctaccgtgccccccaagaagt

SEQ ID NO: 378419 - DNA, 665 bp, Homo sapiens
gcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggacccttaggctcagcaggtggtggctttggcccaaatgcaccacatgggataagccttggagtgtctgaagcctggctccactattgtgtgacaagcctcttctcctctctgatctttagtttttccatgtttaaactagggaagagcacacccttcatccctgccatattaagatatttaggggctttggaaggaaatgcatttgatcaatgcagaagagcatttaaccatgacttcagccaatcctctgcttcttaggactctgacttcaggtccgagtgactagggcactgggcttgctccagattgtggtggagatgctctactaagagatgatgggtgctgggtgagggggagcctgagccagagaccctgttcctggagaatgaatgggatattcataaataatgtacacaaagtaactctttccttctgctctcctgtagctcccagtgcccccatcaactggcgccgg

SEQ ID NO: 378420 - DNA, 168 bp, Homo sapiens
aagctcaagcatgaaaagccttaggatattgctgttgtcccaggacagaaaccatgtaagtagcccttgtcatggtctggcagctgaagacaaagcttgctttccttcaggaacttgtctcgcctccttgacagacattttcgttcctcagccactgccaaattgaga

SEQ ID NO: 378421 - DNA, 3563 bp, Homo sapiens
  misc_feature (3172)..(3172): n is a, c, g, or t
acggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccccccccgccggacaggccgttgcccgccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtnggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtc

SEQ ID NO: 378422 - DNA, 2460 bp, Homo sapiens
  misc_feature (2069)..(2069): n is a, c, g, or t
aagtggctcacattgacctacccagaagccagtgattcccctgtcttactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtnggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtc

SEQ ID NO: 378423 - DNA, 1947 bp, Homo sapiens
gcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaaca

SEQ ID NO: 378424 - DNA, 903 bp, Homo sapiens
gcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcaccttctattcagttttcgggatcctctagacagc

SEQ ID NO: 378425 - DNA, 1450 bp, Homo sapiens
aggaaggcaaatgacaattacactcaacttaaataacttgggactctttaaaatcttatcattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaaca

SEQ ID NO: 378426 - DNA, 4459 bp, Homo sapiens
ggcccggcgaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattcctcgaactccaaatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatctacatcaaatgggtctttggagggcctggataaccaggagggaggggtgtgccagacaagagccatgaagatcctcatgaaagttggacaagatgcaagttctgctggatcaaccaggaataaagatccaacaagacgtccagaactagaagctggtacaaatggaagaagttcgacaacaagtccctttgtaaaaccaaatccaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaaaag

SEQ ID NO: 378427 - DNA, 4320 bp, Homo sapiens
ggcccggcgaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattcctcgaactccaaatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatctacatcaaatgggtctttggagggcctggataaccaggagggaggggtgtgccagacaagagccatgaagatcctcatgaaagttggacaagatgcaagttctgctggatcaaccaggaataaagatccaacaagacgtccagaactagaagctggtacaaatggaagaagttcgacaacaagtccctttgtaaaaccaaatccaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaaaag

SEQ ID NO: 378428 - DNA, 3207 bp, Homo sapiens
  misc_feature (17)..(17): n is a, c, g, or t
  misc_feature (126)..(126): n is a, c, g, or t
  misc_feature (173)..(173): n is a, c, g, or t
  misc_feature (201)..(201): n is a, c, g, or t
  misc_feature (216)..(216): n is a, c, g, or t
  misc_feature (221)..(221): n is a, c, g, or t
  misc_feature (245)..(245): n is a, c, g, or t
  misc_feature (287)..(287): n is a, c, g, or t
  misc_feature (302)..(302): n is a, c, g, or t
gcatcgggaaataggtntcctctgggaaacacaggacccaccaggtccctctcaagaccttgtagaaaatgtcgccggggccctcgggcatctcctggacgatgtacaccggtgcccgtatccccnctgaccttctcgtagtgagggcagaagacgctgtccccagtccttancgggatgataatgtcactgggctctganccgttgtttgttccncttcncttgggtgtggccagtgttctgancgacagcgtggtcgtgttctgcggcgagtgcttcctgtttcncccccggtacttcancaagaggaccaccagcgtgatgatgatgacgatgaagatgatgcatcctgaagcaatccctgcaaataaggccacttcggaaccgaggatgttgttccccgaatgtccggcgctgttgcccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaaaag

SEQ ID NO: 378429 - DNA, 2476 bp, Homo sapiens
  misc_feature (5)..(5): n is a, c, g, or t
tgatnagctgggtccaaagccgacatacagccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaaaag

SEQ ID NO: 378430 - DNA, 759 bp, Homo sapiens
gccatcccttttatttatagactaacattaaatcagtcatttgtgaaggaaggagaaagtgcctaaataaatttggagtcagatagcatacgtgcggcagtgtttccgatatccatttctctttatttctttttctttttctttttggctttcagcatccccatactttcagaaaacttgtgactaagagtgaattcttatttttcaaattgttttcagacatttcatgttcatgtaaacttggcttattgatttcctgatttttctttatttttttgttttgtccattttatttttaatcagctacatcaaatgggtctttggagggcctggataaccaggagggaggggtgtgccagacaagagccatgaagatcctcatgaaagttggacaaggtaaagaccatctgctgcttcatgacgccactgtgacctggtgtagcccccagctagtatggtgctaatgttgccgatgcccaccttcattcgctcttctttttagttttcaaagcaaacccttctgcactttgagccactgacagatttcctcaagtcaatgtactaagcttttattggagatctaagagttaagatcagcaaggtagaatgtctattgccatagatagatagatagatagatagataatagatagatagatagatagatagatatttctttttaaaaagcaaaacactttggttcaaaatcaaaatatccagaatgaaaactaaaagcttgtgcagttttgctcatttctg

SEQ ID NO: 378431 - DNA, 4461 bp, Homo sapiens
ggcccggcgaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattcctcgaactccaaatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatctacatcaaatgggtctttggagggcctggataaccaggagggaggggtgtgccagacaagagccatgaagatcctcatgaaagttggacaagatgcaagttctgctggatcaaccaggaataaagatccaacaagacgtccagaactagaagctggtacaaatggaagaagttcgacaacaagtccctttgtaaaaccaaatccaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtacgtacagagtgaatgtcagggtggagaatggacagctctaagagttttgcttctaaa

SEQ ID NO: 378432 - DNA, 3379 bp, Homo sapiens
actctagagcatccgctttaactagcccgacagcggaagccagcacacaatgagcccagttcctatcctagttgggtgagactggtggggagggctgtggccagagctgacccctccccaaggacatccctcggggccacctttcctcctcctgctccccccggcctcctggaaaactgctcagaagtcagcagagcctgggcagcgtgtggcctgtggggcagccaagcactggagggggacgacagcctaactcctatgagagcagagggaggggtggtggcacagcgaggagggcggtggtgtgggcagcgctgaggcactattctttagttgagaagcaaggggcagtcatgggtgtggggagggcagttggcccatgcaaccctaggcagcatctacgagaaattcttgaagatgtccaggtcgaaggccgtgtccaggaggcgctcgagcttccgtccaggtgggtctgtgtcctggtgtagatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctacttttttatgtgctatgcaaaatagacatctttaacatagtcctgttactatggtaacactttgctttctgaattggaagggaaaaaaatgtagcgacagattttttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaaaag

SEQ ID NO: 378433 - DNA, 1756 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378434 - DNA, 768 bp, Homo sapiens
  misc_feature (23)..(23): n is a, c, g, or t
gaggcagtgaatcgaactcgtgnacctgattggagtgttgttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378435 - DNA, 1612 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378436 - DNA, 2309 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378437 - DNA, 3593 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgcaatcaccacgtgtatttatagcgaacacccctgaggctctggggatcccatccagaacactgtgacctttgagtcgggcagtcagtatgtctatcccaggtcaggaaagccctgccagcaggagcgagcatggaaaccagccccggttaggaggaaggaatcaggtgaacaagccagaatgataaggagcaagctcttccttctcgtctctcagtagagaaactgatcatcttcagatcatccttttcaaatatcttctctagaaattgaactccaacctaaggggaaagaaaataatgccctgtattgccaaatcaggaaacagtgacttcaggaaacctctgttccatccttctgacctcagctaagccagtcagcccacaggaaggaagctggtggttagaccggattgattccgacaggaacattgaatatgatttaccgcagctgttgcaaactgatggcccataggtggatttatttcacaggcatgttttatttaattcttttgtttaaaaaaaaaaaaagaatttaagtgcctttagacagaacatttaaactcaccatcttgtcaaaatgcacatcactcttaagtgtgtgagacacggcccattttcatacatgtgtgacctcctggcccctctagacacccgagcttatgactcctgtcataagctgcggatagcaggtcatcccttatgtatgatttccatgtccagacctttcaggaagctacaggcagagccaggtgattgtctcaaaatatgccagacaattcttgtgatatcagatccagaaaggagccctggaccagaggagcaggagaaaggcgttaagaaggcaaccatgagcaaacacatcttcccccccctagaacgtgagctcagtgtctgcaggggcctggtctgactggctcaacattatacccccagcacctagaaatgagacagaataaatgctcaataagcgaccatctacaaacagacaaaataaatgcccaataaatgctcactggataaaggaatcaaatcctgagggtgcacaacatttcccaagcaagtggcaagaagagtccagagccgtctcgctcccgatgctggcagctctgtgtcctctcctgcttctctctatgtgttccctcgttcatactctgttctcatctgcatcttttccgtttctccactttcaacaggcttccccaacccaaaccaaccccaataacaaaacactggatttaaagttaacaaggatatgatattttactgttgaatatatacaacttcccaaagaagcatagtaaaattaatcacttgcattcttttcaggttagtgtgactgagtccacccacacaagctctggggcttcagaaggcttgaataaagtgatacgttagagtaacacatatcctgcctttactaaaaacctataacatttaattttataaaaagtcaggaaagtcagagaatcctaggtatataatcaccttttaaaaaaatttttcattttaacttaaacatagggataatggcaagccactcataatgttgtcatttgaagatcacaccttttaatgtagctgaatttggaagagagaaggagagaaacagaaatgagaaggtttgcttaaaaaacagatgccagtgcacaaatcttaaagaattataaggcctggtgcgatggctcacacctgtaatcccagcactttgggagacagaggtgggcgaatcacaaggtcaggagttcgagaccatcctggccaacatggtgtaaccccatgtctaccaaaaatacaaaaaattagctgggcatggtggcgggcacctgtaatcccagctactggggaggctgaggcaggagaatcgcctgagcctgggaggcggaggttgtagtgagctgagatcatgcccctgccaacaagcgtgagactccatctcaaaaaaaaaaaaaaaagaattataagagtgcccccaacatcctccttctcttcctgtccctcctcactatttgctgtaacttctgaattttttgttcccaccaaactattcttcatcaacggtggaattgtgagtggctgcataccagcctaccactatgatttgtttttaacttttaaaacaaatgtagtttttttcgggtgcattctacttgtacatgtttatggggtacgtgtgctgttttgatatatgcatacaatatgtaatgatcaaatcagggtaattgggggtatccatcacctcgagcagtaactttctttgtgctttggaacattccacatccactcctctagttatt

SEQ ID NO: 378438 - DNA, 1679 bp, Homo sapiens
  misc_feature (1679)..(1679): n is a, c, g, or t
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgcaatcaccacgtgtatttatagcgaacacccctgaggctctggggatcccatccagaacactgtgacctttgagtcgggcagtcagtatgtctatcccaggtcaggaaagccctgccagcaggagcgagcatggaaaccagccccggttaggaggaaggaatcaggtgaacaagccagaatgataaggagcaagctcttccttctcgtctctcagtagagaaactgatcatcttcagatcatccttttcaaatatcttctctagaaattgaactccaactattgttagggtggccgtactcctaatttgaggcacagattcatagttgtctctctcatatcctcggccgagtacccacgctgcctcgcacctagcgatgn

SEQ ID NO: 378439 - DNA, 416 bp, Homo sapiens
  misc_feature (13)..(13): n is a, c, g, or t
aaagaaagaggcnttttattacattgttacagggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378440 - DNA, 3228 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgcaatcaccacgtgtatttatagcgaacacccctgaggctctggggatcccatccagaacactgtgacctttgagtcgggcagtcagtatgtctatcccaggtcaggaaagccctgccagcaggagcgagcatggaaaccagccccggttaggaggaaggaatcaggtgaacaagccagaatgataaggagcaagctcttccttctcgtctctcagtagagaaactgatcatcttcagatcatccttttcaaatatcttctctagaaattgaactccaacctaaggggaaagaaaataatgccctgtattgccaaatcaggaaacagtgacttcaggaaacctctgttccatccttctgacctcagctaagccagtcagcccacaggaaggaagctggtggttagaccggattgattccgacaggaacattgaatatgatttaccgcagctgttgcaaactgatggcccataggtggatttatttcacaggcatgttttatttaattcttttgtttaaaaaaaaaaaaagaatttaagtgcctttagacagaacatttaaactcaccatcttgtcaaaatgcacatcactcttaagtgtgtgagacacggcccattttcatacatgtgtgacctcctggcccctctagacacccgagcttatgactcctgtcataagctgcggatagcaggtcatcccttatgtatgatttccatgtccagacctttcaggaagctacaggcagagccaggtgattgtctcaaaatatgccagacaattcttgtgatatcagatccagaaaggagccctggaccagaggagcaggagaaaggcgttaagaaggcaaccatgagcaaacacatcttcccccccctagaacgtgagctcagtgtctgcaggggcctggtctgactggctcaacattatacccccagcacctagaaatgagacagaataaatgctcaataagcgaccatctacaaacagacaaaataaatgcccaataaatgctcactggataaaggaatcaaatcctgagggtgcacaacatttcccaagcaagtggcaagaagagtccagagccgtctcgctcccgatgctggcagctctgtgtcctctcctgcttctctctatgtgttccctcgttcatactctgttctcatctgcatcttttccgtttctccactttcaacaggcttccccaacccaaaccaaccccaataacaaaacactggatttaaagttaacaaggatatgatattttactgttgaatatatacaacttcccaaagaagcatagtaaaattaatcacttgcattcttttcaggttagtgtgactgagtccacccacacaagctctggggcttcagaaggcttgaataaagtgatacgttagagtaacacatatcctgcctttactaaaaacctataacatttaattttataaaaagtcaggaaagtcagagaatcctaggtatataatcaccttttaaaaaaatttttcattttaacttaaacatagggataatggcaagccactcataatgttgtcatttgaagatcacaccttttaatgtagctgaatttggaagagagaaggagagaaacagaaatgagaaggtttgcttaaaaaacagatgccagtgcacaaatcttaaagaattataaggcctggtgcgatggctcacacctgtaatcccagcactttgggagacagaggtgggcgaatcacaaggtcaggagttcgagaccatcctggccaacatggtgtaaccccatgtctaccaaaaatacaaaaaattagctgggcatggtggcgggcacctgtaatcccagctactggggaggctgaggcaggagaatcgcctgagcctgggaggcggaggttgtagtgagctgagatcatgcccctgccaacaagcgtgagactccatctcaaaaaaaaaaaaaaaagaattataagagtgcccccaacatcctccttctcttcctgtccctcctcactatttgctgtaacttctgaattttttgttcccaccaaactattcttcatcaacggtggaattgtgagtggctgcataccagcctaccactatgatttgtttttaacttttaaaacaaatgtagtttttttcgggtgcattctacttgtacatgtttatggggtacgtgtgctgttttgatatatgcatacaatatgtaatgatcaaatcagggtaattgggggtatccatcacctcgagcagtaactttctttgtgctttggaacattccacatccactcctctagttatt

SEQ ID NO: 378441 - DNA, 1681 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgagagaacccaat

SEQ ID NO: 378442 - DNA, 1492 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 378443 - DNA, 2135 bp, Homo sapiens
cggtgacgtcacccccagcggggataaagcgcccccgcccgggtcggggccaggacgccgcccggcgcggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaggtaatatgagtctctttgaaccatgggcatattaactaaacacgtgggcaatgtcagctttactggtgtcttttaacattgtcttaatggaaagaaagctatgtgaaaagcttttttaaaatactaaggatttactgcaaatatctaggcttggaaagaaagctatgtgaaaagcttttttaaaatactaaggatttattgcaaatatctaggcttggtgataaaggtgatttgaggaattatctgtagagctttatgtgtcagatagcaataaaatgaaatcaggtaaggaccaaatgtatatgtctctcgaaagctacaatgtactttacaaatatctggtgtaatacttctcaaagttatttataatctagtataccctatgtctgtcctttggggatcaaaaattaggaaggaggtgggaggtttagaggaattttatgagatgattcttctctcttctgatagcagcttgtggagaggtcattatttactcatttacaatgtttattgtgcataaaggtttttaggtgaataccctcaggctgttaatgtagatatttaatttttgctggtctctttttgactaattttttctttgttataactatttgttcacagtacttttgccataaagattttgattaaaaagatttattataggataaaatcttactgcttctttcactattacagaatcactatttataaattaaattattataatgcttcagagtgttaaatagtgatatcccaaagctatctcttgggatgaacacattgaactaatagtagt

SEQ ID NO: 378444 - DNA, 438 bp, Homo sapiens
cactcatcactttggcaaaaagtaaaatttttttagacggagtcttgctctgtgtaagtttcgatctcaactcactgcaaccttcaccttccaggttcacgcaattcttctgcctcagcctcccgagtagctgggactacaggcgcctgccatcacgccgggctaatttttttttgtatttttagtagagacagggtttcaccatgttcaccaggatggtctctttatctcttgacctcgtgatctgcccacctcagcctcccaacgtgctgggattacaggtgtgagccaccatgcccggcccactttggtaaaatttaaggagtacaatgtaccgttgatgaggatgtggagaagcaggaactcacaccatgctagtgggaccatgatttgctctatccctttggcaaagtaatctggcaatgtttattaaagggc

SEQ ID NO: 378445 - DNA, 289 bp, Homo sapiens
caaaaataaaatgtcatttatatttgagacagtgacatataaacaaaaatgtaactcttttcgtttttcagaattatggctaaatagagaaaataattgatctatggtgggtcccaggcaagttgactctgatttagagcaagatcctattgaggccaaggtcatgggtaaatttcttaagagggccagttaatttggttctggaacatagcaagaagttgtactcctgacctcagcttgccaactcacttcatggttgcaaaaggatagaagatggatgattcagttt

SEQ ID NO: 378446 - DNA, 846 bp, Homo sapiens
tcccagtagagctggggtgtgacgccccctcagtgcgtggatgagctcttgttcagctctccagaagctctggagccctgtccttttgggcattttatggaggtttcattggacaggcctgattgaagcttggacgactgtgttgaaatgtgattggacagaaaggatgtgatctaaacccagcaaggcctttctgttcagatccttcttggcctctttgtgcagcattccttcccccagaggatgaggcaggaccctctctgattcgaacaagagtcttatgacccataatcagattagagtcctaccctggtaaggtaaaaggaagacaggagaaggttagagattctgttgactgcaacaagggatatgaaagttatgagccaggaattgtgaatgaaaactgatgtataatatatgtcataatctcacattgctgcttgagagatcaaggtgaagactgcaaggtctttgcaagctggaggctaatgcttagtgaacagtctggatagagtgataacagtagaagcccattcagagggtactcgagtgaatgcaggctgggcgtggtggctcacgcctttaatcccagcactttgggaggccaaggcaggtggatcacttgaggtcaggagtttgagaccagcctggccaacatggcgaaactccatctctactaaaaatacaaaaataagccaggcatagtggtgcaggcctgtaatcccagctactcgggaggctgaggaatcacttcaacctgggaggcggaggttgcagtgagccaagatcgcaccactgcactccagcctgggtgacagagcaccgctctgtctcaaaaaaaaaaaa

SEQ ID NO: 378447 - DNA, 406 bp, Homo sapiens
tcccagtagagctggggtgtgacgccccctcagtgcgtggatgagctcttgttcagctctccagaagctctggagccctgtccttttgggcattttatggaggtttcattggacaggcctgattgaagcttggacgactgtgttgaaatgtgattggacagaaaggatgtgatctaaacccagcaaggcctttctgttcagatccttcttggcctctttgtgcagcattccttcccccagaggatgaggcaggaccctctctgattcgaacaagagtcttatgacccataatcagattagagtcctaccctggtaaggtaaaaggaagacaggagaaggttagagattctgttgactgcaacaagggatatgcactgatagggtatgctctatcgggtcctctgat

SEQ ID NO: 378448 - DNA, 426 bp, Homo sapiens
tttttttttccaagggtgtagggtgtaatctggatgggaagtagaaataattttgaaaaactctcacaagtgctatttaaattcttatcataaattaaaaagtttaattaagtaccttggtaaaggcccgggttctatgattaactacgacaaaataatagttatgatgactgatcaagtgaggaactttatagctctgaactttgtctttaaagctattattaattttaattgaaatagctaagagactccataatgggagaaagaaagaaacatgaaggatattttgttcatatacagaggagtttaaaaatgaatagatacgccggtaactattttaaaaaaattgatgcaaacaagtttactttcagaggccttgtcataaatctatttcaaaatgttgattattgtggtcatcctacatca

SEQ ID NO: 378449 - DNA, 1982 bp, Homo sapiens
agcggagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaagaaaaagatgt

SEQ ID NO: 378450 - DNA, 2600 bp, Homo sapiens
agcggagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacagacgggggaaacaaggatcaagaatggccaggcagctttctggggaccaccggcaccgccgccatcagaactttggggtgtttgagcctctggcaatgcctggcacagaaaggggagttagtgaagctagcccccctgggaggtcttgaaggttaggaagacatgggtctactggaaggcttaggtgtggctcagccgggctcagaggagggggtgggcccagtgagccttccagctgcacagagccataattcacgatgccttctagccccctcctttttgtctggaaagaagggtcaaggagctacagggtaggaatttcacttggtggccatctatggctttctttgggagaactgttttccaggcagggggtggggtggagaacaatctaacttccaaggttaacactttgacgttcttttttctgacgtgcagcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaagaaaaagatgt

SEQ ID NO: 378451 - DNA, 1335 bp, Homo sapiens
agcggagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacagacgggggaaacaaggatcaagaatggccaggcagctttctggggaccaccggcaccgccgccatcagaactttggggtgtttgagcctctggcaatgcctggcacagaaaggggagttagtgaagctagcccccctgggaggtcttgaaggttaggaagacatgggtctactggaaggcttaggtgtggctcagccgggctcagaggagggggtgggcccagtgagccttccagctgcacagagccataattcacgatgccttctagccccctcctttttgtctggaaagaagggtcaaggagctacagggtaggaatttcacttggtggccatctatggctttctttgggagaactgttttccaggcagggggtggggtggagaacaatctaacttccaaggttaacactttgacgttcttttttctgacgtgcagcactggtggtccggttcctcaccaaacgattcatcggtgactatgaaagaaatgcaggtgagacaatgcatttgagaaaaattctgtcccattgcaggaggactgcggttcccattttccagcgcttcccagggaggttctttcagtgacagtccgagcctgaggatcccgccacttaaaactttccccagtccccagccctccatggcgcccccctcccataactaccatctggcctcattccattccaagcccattcatcattttatcaagtgcctgaaagtattccccttggtatgttttaactatagtgaccccagttggaagcaccctttgtagtcaagaacctctcccttcaaaacactcctgcaaaagtcgt

SEQ ID NO: 378452 - DNA, 408 bp, Homo sapiens
cctctcaactccttaagcttccccctggccccgacccctgcattccttctcacggtgccccctccaccttcgagccaggaaaggagtgtcagatctccctgtgatttgaatctctctgattttctctcctgccacctgctggagaaggcgctctgcttccaggaggtgatgtgatgctaattagactgagagagcaccgccccccacccccgccccgcccgatgatcccctttcttaaggtctgctgtggtacacgacgacatacttgacgacatactcaagggtgtggcaccttgtcatattcacaggttttaggcattggaggggggctagagtgagagggatgtcattttagaaattctccccacagtagaaagactcttctcttaatggggccagccatggtgg

SEQ ID NO: 378453 - DNA, 735 bp, Homo sapiens
tgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacagagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagacttctccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaacttccaaacct

SEQ ID NO: 378454 - DNA, 625 bp, Homo sapiens
aattaaatgactaggaagttaattaactgtaacaatgttggggtttatttttgcctgcaatgacacagctaagaaataaagcaacaaaacaaaaatacacagtgtttccagagtatgtttctgaactatctgcacaaggatcacctggccgccttatcaagatgcaggtttctggagcccatcttaaaacgaactgaattataatctgaattggagtggctgacaaaggcttgggaatctacatttataaaggtacatcagtaattattttgcatggtaaaatttgagaaccctggtacaggttattatgccttacaggttagcaaggccttttacagaacctcatttgacctcaaaacaatccaatcaggtgaatcaaggaaaaattattccctcataagggctatttgttctgagtaggtagtggttttgtctactgtgagggtctataggatagagataaagccattcttactgcaatgatatcttaagtaaaattagatgtcttacaaatgtacaactaaactccctatcaaataagctcctgccctaatccctccagcctctccacacaaacaaacaatgcatctctcttgtgatatagcaactctgtaagtgggtacaa

SEQ ID NO: 378455 - DNA, 412 bp, Homo sapiens
aatttttagaattaataagtcagctgcgtgcggcagctcacgcctgtaatcccagcactttgggaggccgaggtgggcagatcacaaggtcaagagatcgagaccatcctggccaacatggtgaaaccccatctctaccaaaaatacaaaaattaaccaggcgtggtggcgtgcacctgtggttccagctactcaggaggctaaggcaggagaatcgcttgaacctgggaggcggaggttgcggtgagccgagatcaaaccattgcactccagcctgggcaatgagagcaaaactcagtctcaaacaaacaaacaaaaataagtcagttcagcaagattgcaaaatacaaaatgaacataaaatacaaaatacactatttctatatactagaaatgcacacataaaaataaa

SEQ ID NO: 378456 - DNA, 4396 bp, Homo sapiens
  misc_feature (679)..(679): n is a, c, g, or t
ggtgttttgaaacataaaaggttgcaccctcgtgtgtgccttgtgttaaaaggagcccacgcagccgacggcagcaggagcaaatggcctgctctgatggggacaggcaggaagtccttcggggcatttctgtttcatcacagcttttcctggggctggtgagtctgttgggcctttggttgacagggaagcgcatgagcccatgttggtggatacaaagcatttggggcctggcagaatccagagaggggaagaaggtggccctaggaactggcctattttgtgatccccagagaccagtgtggctgacccattagtgctacaaatccatagccaggcctcaggacagcttttggtcttgtttttattaagccactgaccagtggttaggagcaagtggatcataaccttaacatttttattgaaaattggagccttgacctggggatgtgaaacccacaagctgcacatttctctgtagactgcatctggacacttgtcacattgccgactgggtctgacagtcatcgccaggactgcctgggcctgtgttcattcccagtcaatgagtcctgggacacagacgtcccggactcgtgcccggtgccaggcctcatgcccgcccaaggatgaagacatacctgccatcaccatgcaagtgccgggagctcttctcagngcttatgtgtgggaacacgagtaatcccacaccctaggaggtggcactactcttaccccagtgtgcagatgaagatcagaggccagaaaaggggggtgacttcagtcacacagcaagcatgtggcagagctggagtccaggtcgtcattctgagcctgcccctggctgggccattgtgctttgtcacctctctacagaaggtgggcctcatcccctacatcaggccccaagcctggccagcgctcttcccaccctgccccaggccacctgctatgcctgtgagggctgtgtgtgagcactctctggagcgccgctgattctcttgtctctcccctgcgtcctgccaggaagctgatcagtatctcctttggggacctgaaccctttccccctacgccagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378457 - DNA, 4380 bp, Homo sapiens
tgctctagaggatccttggatgctgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378458 - DNA, 1853 bp, Homo sapiens
  misc_feature (21)..(21): n is a, c, g, or t
ggctaggtagaggcgggtgtntggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378459 - DNA, 1859 bp, Homo sapiens
gagtgttacgagtgccgtaccggttggtagtacgtgagagtagcggataaaatctgagaatatcaggcccggttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378460 - DNA, 5762 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtatggcctcccacctgcaaggacttccccggcagcgccagctgcccagaagccccg

SEQ ID NO: 378461 - DNA, 2381 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgccttctgaggtggggcaggagtaatgtttgttgttgggcagagttcgcagcaagtccagctctatctgcttggcgggtcttgcgccgca

SEQ ID NO: 378462 - DNA, 5957 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378463 - DNA, 2347 bp, Homo sapiens
  misc_feature (76)..(76): n is a, c, g, or t
caaatgagctgtaatcaaatgatacttgtcaacagctgttatatacctgatatacttttttgaacagaacttgaancatcttcccagaccttattcctgcatgttttctagggtatatttgatttgtctgataaggtggcagatgggagctagtcctggaccacagtgtcctaagaaagaatgggtatagcatggagtggccactcatgggccatgtgccagatggcaccgagctggacctcagtaattggcatgtagcctggttcctgctgctctctccacctctgtccagaggtgatgcatttgttggcatccagaggtctgattatcagcactccttctataaggaagagaggaacccactgcaggccattttaaacatgaaaggtggtctgtggcataaattaatttcttgtctttgctacagtctgtctctggctcacttcctaatagttttgggtttgttgttcactggtcatttgcgtacctaaagattgctcttcctgtgtctctgtctgaatggaggtaaccaccacattctctgcagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggtgagttagctcagctcagctattttcagatatacacacttgacaaccgtcagcagcgttggtggcggtagagcggctggctcacctggaacttatgagggttaccatggtgcccaagggatctcagcacggcctgcactagatctgggtccagggtatcaggaaaccacagtcatttgttcatgtatcagaaacattcaacccacatcaagccctgtgataggcgctgggagctatggcttacagtttgagcctgagcctcaccatctgtcaaatggctggtggtgttaccccatcatatggaggaggagatggaggcccagagatctaataagcaggggattaggggggctaatgagggggactaacttgggggagccaacttcagagccttactgcccatgagcctcccacccgctctgttgtatgttttttaaaaatcagtttttgaataaggaatatatttacatattaaaccctaattgtataaacaggtgtttgtaatggagtggaggcccctccctagtcttctagttactcttctcaatttattctttaccttagccgggcacagtggcatgtgccaattgtctcagctacttgggaggctgaggtaggaggatcatttgagctgaggagttaaaatatagcctgggcaacacagcaagacccagaaaacaaactaaattagagaaagtacaggcccttagatatggggaaagcagtttgttccaaagctgcttgaacttgcaagactaccaggagtccattccctctaacctctaatgtaccccaaacacaaattaa

SEQ ID NO: 378464 - DNA, 3732 bp, Homo sapiens
tgctggtgtctagaggatccgccaggctctcaggttgtgcgtctgctcgtctgcttaccggtgactggcaggcctgatacacttctcccctttgttccctctccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378465 - DNA, 5915 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaacccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggtagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgagcgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 378466 - DNA, 2739 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtagttctgaaaattctgtgttttagtcaccacttttagaattgcagctgaaatgtgacctgaattaaacctgcggtcagggtgaggggttgctttgtgtatgtgacttcagagactgattcctgaagacagcaggccacatctcagaggctgtccccagtcatggcctgctgtttgtgactgaggccgagttgggctcattcagccccctgcgaaccagcagagacagacccgtcctgcaggcctaacattgtgttcactgctctgcactgtcttccccggacacaggcctaccagtgggctgagtcataatccaggtgtgcttgggtgactggtgtgttagctcaggctctcaagaagcaatgtcaggctggaatgagacaaaccagagacttcggcggggggaag

SEQ ID NO: 378467 - DNA, 2097 bp, Homo sapiens
cagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccagcaaacacaaagacctgcggaccaagggcttcaggctagagtcgtgccgcagcatggtgaacctcatggatcgtgatgggcatgggaagctgggcctggtggagttcaacatt

SEQ ID NO: 378468 - DNA, 445 bp, Homo sapiens
  misc_feature (120)..(120): n is a, c, g, or t
  misc_feature (128)..(128): n is a, c, g, or t
tcctctacactccatatgcacaaggcttttaccatctaatatgggacatacatggaaataaataacaaaaagagtactattacagtttgtgttcaagagttgtctggacactgtggctcncacctgtnaccccagcattttgggaggctggggctggtctcgaactcctgtcctcatgatccaccttcctcagtctccccaaatgctgagattacaggcatgagccactgcacctagcccttttacatgttttctaatgcatatttggattatccattgagagtaatacttttcagaagcttacactctttaaataggcagaaaaccaaaactgaaaatcaaatatatcactagtttggaattaatctagataaatgaagttctgttatctactgtaatcaatttatcacctttgtaagttgcattttggagatttaaaaaaaaa

SEQ ID NO: 378469 - DNA, 831 bp, Homo sapiens
cttaccacacaagaccagggtggagaggtagggggaaaagagggcaggtggtgctcagagtggggtacacagggaagggcaccccaaagctgggctctgcgcccttgagcccctctagatgggtatgcaaggtcaagatcatcctgcagggactagaaagctgtctgggaggagctgtgtttgtgcctgggtgtttgccactacttggggtagtgggtgtgtgtttggagttggagagaagatgatatgtatgaatatctatatttggatgtgagtggttctatggttttgtttccagcgggcattgcctgtgtgtggagagactctatatgtttgtttacgattgtatgtgttttcttgtgttggcatgttctgcatttgtgtgcatcctggtgagagactggaggtggtgtgagggacagggggcatatgcacacttgcgtgtgtctgagtgtgtctggatgctggtgcccccacctacaacatttgtgttctgttcctggaacagcgccatggggcaagcgtggctggaagatgttccacagagaaaacagcaagccgggtttgctcagaacatggggtgtgtgaaagggaggtacacttgaggcaaaattgccagggcctgcatttgggccttattccacaggcagctgaaggcttttgattatggcaccaacatgtccagagtggtgttctcaccagactaatgtgcaagcacagattgattaggctggggcgaccaggatgggactagcattgcttgtgagccgccggcccctaggctgctttttccaggcttagatggatctacacacaagtcagggacaatag

SEQ ID NO: 378470 - DNA, 4869 bp, Homo sapiens
cacattcactgggcaagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378471 - DNA, 5070 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagcaaaggtcctgagcccttagttgcctggaggcttgagtcctgggagcccgctgtctgctgcctctgcaagtgggagaggtcactgcccgagggaggacagggcatgctgccaggctccaggggaggagccccagggagggagcctctggaggtggtgcccaggccgttctcctgcctcctgccctgtgcccgcctcacttcatgttcttcctcagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgaaaa

SEQ ID NO: 378472 - DNA, 4592 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagcaaaggtcctgagcccttagttgcctggaggcttgagtcctgggagcccgctgtctgctgcctctgcaagtgggagaggtcactgcccgagggaggacagggcatgctgccaggctccaggggaggagccccagggagggagcctctggaggtggtgcccaggccgttctcctgcctcctgccctgtgcccgcctcacttcatgttcttcctcagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttgggcctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378473 - DNA, 2795 bp, Homo sapiens
cttaccacacaagaccagggtggagaggtagggggaaaagagggcaggtggtgctcagagtggggtacacagggaagggcaccccaaagctgggctctgcgcccttgagcccctctagatgggtatgcaaggtcaagatcatcctgcagggactagaaagctgtctgggaggagctgtgtttgtgcctgggtgtttgccactacttggggtagtgggtgtgtgtttggagttggagagaagatgatatgtatgaatatctatatttggatgtgagtggttctatggttttgtttccagcgggcattgcctgtgtgtggagagactctatatgtttgtttacgattgtatgtgttttcttgtgttggcatgttctgcatttgtgtgcatcctggtgagagactggaggtggtgtgagggacagggggcatatgcacacttgcgtgtgtctgagtgtgtctggatgctggtgcccccacctacaacatttgtgttctgttcctggaacagcgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378474 - DNA, 2023 bp, Homo sapiens
ggaggcgggctgcgcacttggcctgggaaccgaggcggccaggggggcggcgcgcccgggcccggaaagcggcggaggggacgcccgggacagcgcccctcaccgcccgctgctcgcaggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378475 - DNA, 1223 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagaggtgagccctaataagggggtttgggaaattgggtcctgggaggatttggaatttggagtggggacaaagatcattcttggatccatggttgccattaatgggtcccattata

SEQ ID NO: 378476 - DNA, 400 bp, Homo sapiens
cattgggaagagcatgagctgccaggaattcataaccaacctgaatgggctgagggatggcgggaacttccccaaggagctgctgaaggtatgtgccacggggtcttcttatgagcctcatgtaggacctggagccttggttctttgttccaagggagatgctgagcttgggactggctttgccaaaatatccttgagagaacaggacttgtttattgaagggctagtaaaagtgtattccctggcgggcagcatcagaagcatcttggaatttgttatccatgcaaatctgcaggctccctgtgctggacttattgaatcagactctctgagactgggacccctaaaatattttcttaagttttcaagtcattcttaccccttcaaagtctgagaaggg

SEQ ID NO: 378477 - DNA, 4750 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagcaaaggtcctgagcccttagttgcctggaggcttgagtcctgggagcccgctgtctgctgcctctgcaagtgggagaggtcactgcccgagggaggacagggcatgctgccaggctccaggggaggagccccagggagggagcctctggaggtggtgcccaggccgttctcctgcctcctgccctgtgcccgcctcacttcatgttcttcctcagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378478 - DNA, 2811 bp, Homo sapiens
gtggctgtctagaggatcccttccgggttgtgcatccgagtctggacgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaaga

SEQ ID NO: 378479 - DNA, 4376 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagcaaaggtcctgagcccttagttgcctggaggcttgagtcctgggagcccgctgtctgctgcctctgcaagtgggagaggtcactgcccgagggaggacagggcatgctgccaggctccaggggaggagccccagggagggagcctctggaggtggtgcccaggccgttctcctgcctcctgccctgtgcccgcctcacttcatgttcttcctcagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctccacaaagtaaggttggcccttggaggccatgtttgggtctccggccagggcctagggctaggccatgcacccaatgggtgcacaataaataacaggtcaacaaaga

SEQ ID NO: 378480 - DNA, 2064 bp, Homo sapiens
gcagtactccccggtctaggtacgaggctgggtgtttacagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagcgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtgggcacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaagtaaggggctttgagcctggggaaggctggaggctgaggcagccagggaggagctgctgaagggctccctccactggccaccctccccttcccgtccctgccctgttcccttcccatctcccctcctaacttttcccccataccctcactgtatctgctgcttactctcagtcatggtcctcatgctctccacacccttggtccttggtccccactgccttgccaaccagactccacaggtctctcccagtgtctcccagtgtacactgaatagggtagcagggcataccagaccctggctgcccccttgctctgtcaggacccaaggcccagcgtgcctgcacccttcccttgctcaccccca

SEQ ID NO: 378481 - DNA, 280 bp, Homo sapiens
gatttgagatgatgaactattatgtaaaattataaatgagcaaaatgttgttttttgtattgttaatcaaatcagaaactggtttaaaagatttacaaaattcacaagggtatgaaaaacagaggttgtatttactgattggtctgtttaatggaaattgtctaatggaattgtctcatattttcaaatgggattttgttttcatggaatttaattagtctgattataatttacaagttcttttaaaaagtacaggagcagctttttaaagtttgagaaa

SEQ ID NO: 378482 - DNA, 428 bp, Homo sapiens
gcttaatacaattatttgtattaagcactagccacctgttaggatcattctcattaaaggtcactgtgtggtgcctgactgtctgactatggcagcctgcatcagatttgctagtggcccctggtttgtgtgacacctgccaatagtaacagaaagaatggagatctgatagctcaaagggaacagaaggtactagaggaggaatgaggaatcaggagaaccatggagcacctgccactctagcaccattaccatggtttttggtgctaacttgcctagtctcccttttctctggctaccccttcagtgagctgtgccaggcatttcgaagagttctgttattgtctgcatgctgatattgctttggtttattgatattaagacattcagcagaggggatgtaaggaatttcaggtacaagaaattca

SEQ ID NO: 378483 - DNA, 443 bp, Homo sapiens
tgggccacagagtgagactccgtctcaaaagaagaaaaaagttagagcaatgaatctatcccatattaaggcctactggataactacagtaatcaagacaacacagcattggcaaaaagagagacacataacatagatcagtggaacagactggagaacccagagacaggcccacatgaatatgccaaactgatttctgtgccattcaacaaacagtgctagagcaattagacacccctaggcaaaagcaatgagcttctacccaatcctcattgtggtacatccataccatggaatactactcaacaataaaaaggaacaaattattagtacgttccacgacctggataagaatccagggaattaaattatgctgagtgacagaaagccaatcccaaaatgttagatactatacgagtacacttacatagcatttcccagat

SEQ ID NO: 378484 - DNA, 585 bp, Homo sapiens
  misc_feature (42)..(42): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaacagagcaagactcagtctcaaaaaaaaaaa

SEQ ID NO: 378485 - DNA, 3922 bp, Homo sapiens
  misc_feature (42)..(42): n is a, c, g, or t
  misc_feature (3921)..(3922): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378486 - DNA, 3580 bp, Homo sapiens
  misc_feature (3579)..(3580): n is a, c, g, or t
agtggtgagcacggtgtcgggggccgcattagctattgatttatgtgctgttatagaattaattgagtctggacatggggactcattttcttggacatgtagcagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378487 - DNA, 3868 bp, Homo sapiens
  misc_feature (42)..(42): n is a, c, g, or t
  misc_feature (3867)..(3868): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacggggtgagcctcttcttgtgtctggagattctgatggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378488 - DNA, 3811 bp, Homo sapiens
  misc_feature (3810)..(3811): n is a, c, g, or t
agcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttgaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378489 - DNA, 1029 bp, Homo sapiens
  misc_feature (1028)..(1029): n is a, c, g, or t
cccacgcgtccgactagttctagatcgcgagggccgccctttttttaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378490 - DNA, 1650 bp, Homo sapiens
  misc_feature (42)..(42): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagaattcagagatgcctgcaccagctgggttttgaagaatgaataggagtttgccaggaagattctagaggaacaacagcaacaaaaagatttaaacatgggcacagaagagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaac

SEQ ID NO: 378491 - DNA, 322 bp, Homo sapiens
tatgagcattacagaaacaaatcttcagttggctaccataatagcaatgatgaaaattatgaattactctcacctctacttttgttcgatagagaacaagtcgtttaaggctgcataacttggcaatgtggttgaaagcttgaggtgggtggcatcatttccaagtttcgtggctgttccagggccctgcgaaccagaagacctcatcgacgggatcatctttgctgccaattacctggggtccacccagctgctattgaaacttctaaaactaggcctagtttgagaagtttcaagtagcaccaagaaagaaagagaaaaa

SEQ ID NO: 378492 - DNA, 3891 bp, Homo sapiens
  misc_feature (42)..(42): n is a, c, g, or t
  misc_feature (3890)..(3891): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378493 - DNA, 3810 bp, Homo sapiens
  misc_feature (42)..(42): n is a, c, g, or t
  misc_feature (3809)..(3810): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgann

SEQ ID NO: 378494 - DNA, 3282 bp, Homo sapiens
  misc_feature (42)..(42): n is a, c, g, or t
aggcggaacggccggggcgggggcgcaggccggcagccgcangcggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaac

SEQ ID NO: 378495 - DNA, 1045 bp, Homo sapiens
aaatgaaagcaccataaaaattaactttgtcatttaaaatatattgtatttcagtttagtttaacaattattgtatgaatttacttttaggatctctgatttggatatgtctcatatatttttatacctaaacacttgcttttcatttcccacccattgcacagtatttagaaaatataggtaagcaaatttaagtagtaattcccaaaacaataataaccaaagacaagtcagaattaatgttttgacgtgtatctttccagtctttcatctaagcctattttttggcttatccttttttatattattctaagtcacattatgcacagatatcttatacatgtagaattacgcaaaccacccaggttttaagaaaatgtcaatggaggacgttaacttaattgtcaaaaaagtttagaactatgagggacttaggagataagctctggttccatgacttcgtgtctgaggagagtgaagcccctcagagtgcagtgggggcctgcgtgccagatgctccaattcctgagcacctgttccttgccctgccctctgctgagaagccactagaatcctttcctagaacaaggcagggtatgaataagatcagtttatttttaggtcattgaacaaatcaagccccatgctatcctccttacccatatttgccctttaataataaaggcaggaagcctatggttgaatgtttgccatgtgcaatttcccataaaacacaaagcagcagcgcaccgcgtggtggccaagagcaggcaagttatctgatttcctgtgctggtttcatcatgtgtagtgtgtagaaaatggctgcatctcatcaaggtgttataagggttctatcagatcatgggtacaaagtacttagcacagggcttgacctataagctctcaaatacttgtgcatataaatattatgtatgtaaagttactcaataataaaggcttattataatagtattatgtaatccagctgctgaattctaacacagttttatgataagtaggagtattaactatctgtttttga

SEQ ID NO: 378496 - DNA, 510 bp, Homo sapiens
ggaggtgatctagaggatcccaagctccaacaagactaaatgactctgaattcctgagaaaagggaagagggttaggacagaggaaatggaatcatttagtcaggtaaagggagcaaagccaccgaaggcagtggttggaggtgtagatgtgaggaagttgggttgagaccattcaccatcaaggcttgaagatgagtgtctgtttgtgtgtgtcatgttggctgtgagttgcagaagagagtatctggcctctagttgaggagcacttccggcttctgagctgaacatggtgtagaagagaggatactcaatccaaaaccctggctatctatgcagagggctgaccagttctacccatgtacccttccttccctcacccttcctcacaaacaggcatattgagagctgtctggcagtcaatccaggcgaggcagcaggtttgagaatgggcttgtccgcctggcacctgcttccccccacttccaccttcacccctccatcccatatat

SEQ ID NO: 378497 - DNA, 589 bp, Homo sapiens
ggccctctgctggtacgtgtccctttactgactaaatgacttccatttcctccgccttcctcttcaagtttttctttctgattgggtttcctgaccctgattgctggtatgggtaagaatgactctgaattcctgagaaaagggaagagggttaggacagaggaaatggaatcatttagtcaggtaaagggagcaaagccaccgaaggcagtggttggaggtgtagatgtgaggaagttgggttgagaccattcaccatcaaggcttgaagatgagtgtctgtttgtgtgtgtcatgttggctgtgagttgcagaagagagtatctggcctctagttgaggagcacttccggcttctgagctgaacatggtgtagaagagaggatactcaatccaaaaccctggctatctatgcagagggctgaccagttctacccatgtacccttccttccctcacccttcctcacaaacaggcatattgagagctgtctggcagtcaatccaggcgaggcagcaggtttgagaatgggcttgtccgcctggcacctgcttccccccacttccaccttcacccctccatcccatatat

SEQ ID NO: 378498 - DNA, 898 bp, Homo sapiens
ggctcactgcaacctctgcctctcaggttcaagcaattctcctgcctcagcctccgagtagctgggactacaggtatgtgccaccatgcccagctgatttttctatttttagtagagatggggtttcaccatgttggccaggctggtcttgaacttgtgacctcaagtgattcgcccaccttggcctcccaaagcactgggattacaggcatgagccaccgtgcctggcagaaaagcttcttttccagttctgaagagtgtgaaggtaggagagccagaattcagttctctcactttccaacccagtacctggagagagagtgtcttgctggtcactggggagtgataggatccggatgcccgccttcctcttcaagtttttctttctgattgggtttcctgaccctgattgctggtatgggtaagaatgactctgaattcctgagaaaagggaagagggttaggacagaggaaatggaatcatttagtcaggtaaagggagcaaagccaccgaaggcagtggttggaggtgtagatgtgaggaagttgggttgagaccattcaccatcaaggcttgaagatgagtgtctgtttgtgtgtgtcatgttggctgtgagttgcagaagagagtatctggcctctagttgaggagcacttccggcttctgagctgaacatggtgtagaagagaggatactcaatccaaaaccctggctatctatgcagagggctgaccagttctacccatgtacccttccttccctcacccttcctcacaaacaggcatattgagagctgtctggcagtcaatccaggcgaggcagcaggtttgagaatgggcttgtccgcctggcacctgcttccccccacttccaccttcacccctccatcccatatat

SEQ ID NO: 378499 - DNA, 280 bp, Homo sapiens
acttattcatgctcccaacaattctctgtggcaaagctttaccaccccactttgcagacaaggaaactgaggcccaaagactctgagtgatgaaactggagatcactctcaagtctctttcacagtaaacctttgggataagattctggccaagtcatttgggaggctgtgctccgtgtcccaatcatattagaatccaccatgggccgggtgcagtggctcacgcctgtcatcccagcactttgggaggtcgaggcgggcagatcacgaggtcaagaga

SEQ ID NO: 378500 - DNA, 1680 bp, Homo sapiens
tctaggatggagtaacagttcaacccccttagacccatcccttctctctctgtttctcctttgacttcgaagttaacaaaaacatttaatcgcattctaaatgcaaaagccccatgcaaacacttggaattgggaaaagaggagaatacaacagtttctgccctcaaggaacataaagacagagtcacagagaccttgaagaatggaggaggtagaaaaaggagaaatgcaggaaggaggtgtgttatggagttatccagtggaggctcgcatccagctttattttgcctccaaagatcttgcatcctacctgttaagaagcttggaatgccactattccattaaatcttaaaggaacttgagtctttcatttaaaaatgtgttcctaaaatgtaaatgtccctatgtgggacagtatttagccgacagtaaatttgagaggagggtctcaaggggcagtgtcaccaggaaaagagagaaaggctcctctccccaagtcaaaccttaccttacttaaccgattgtatttcctccctcagaggatgccatatctcagtacaggagagaaaatagaaggtagagagacttttacccaagcaccccctgaaccccaggtgtacacaactgaacctgatgcagtgacaatcacgttcacacataaaacatctggctaaaggctaagatcacttcggatttccgacatacattttcctaagcagtgcatttttctttaattttccttagaaaaagactgtaaagtagccccacaattcccacatcttcatactccaccctgcattcaagttttcctgggacaggtatctatgtgtgtgcatgaatctatttttacggcatatgtctaggaccccctacgaggagccaaagtttcagagagcccagcaactatgtaactccatggaagggaggcatgatattactctctgttcacaggagcgtacgcacagatcttttctcctcctcatggtcagttttctatttgtgattagtaattagcttctcttggtacgctacgatctattacaaaagccaaacattcagggggcgagctgaaatgacaaaatttggctataatttatgttggcccctgacatatatatttttttaatggtttggtctctaagcaactgatctcttagcaacaagaagcacctttataaaagatggcacacgaagagtgattgccagaaaagccacctggttcttaaacagccgcgcatcattagcaaaactcaccatcttcaagagtccaaaaactagaagtgaccagcagacccaggtaaccttgatatttgcaccattttcctggggaaaaaaaaaaaaaaaaaactcatgcaactattgaagagaacaaaattctttgaaatatgttcatttttgaggtcttattagttggtcttgactaacttttaataatagtatgtattcttttaaataactgctttttgatttttttaaaaaaacgtgatatttgtgatcagaaaacagttcacttgaaatatttcattggcatgagaatggaaggaggggaacaatctatctgtttcagaatttatttctgtaggttttcatttgatgggaaaaaaatccacatcatggcaaaaataggagtatacagaatgtcacccaagtggtgtgcactattagggaaatacgctgtat

SEQ ID NO: 378501 - DNA, 1417 bp, Homo sapiens
tctaggatggagtaacagttcaacccccttagacccatcccttctctctctgtttctcctttgacttcgaagttaacaaaaacatttaatcgcattctaaatgcaaaagccccatgcaaacacttggaattgggaaaagaggagaatacaacagtttctgccctcaaggaacataaagacagagtcacagagaccttgaagaatggaggaggtagaaaaaggagaaatgcaggaaggaggtgtgttatggagttatccagtggaggctcgcatccagctttattttgcctccaaagatcttgcatcctacctgttaagaagcttggaatgccactattccattaaatcttaaaggaacttgagtctttcatttaaaaatgtgttcctaaaatgtaaatgtccctatgtgggacagtatttagccgacagtaaatttgagaggagggtctcaaggggcagtgtcaccaggaaaagagagaaaggctcctctccccaagtcaaaccttaccttacttaaccgattgtatttcctccctcagaggatgccatatctcagtacaggagagaaaatagaaggtagagagacttttacccaagcaccccctgaaccccaggtgtacacaactgaacctgatgcagtgacaatcacgttcacacataaaacatctggctaaaggctaagatcacttcggatttccgacatacattttcctaagcagtgcatttttctttaattttccttagaaaaagactgtaaagtagccccacaattcccacatcttcatactccaccctgcattcaagttttcctgggacaggtatctatgtgtgtgcatgaatctatttttacggcatatgtctaggaccccctacgaggagccaaagtttcagagagcccagcaactatgtaactccatggaagggaggcatgatattactctctgttcacaggagcgtacgcacagatcttttctcctcctcatggtcagttttctatttgtgattagtaattagcttctcttggtacgctacgatctattacaaaagccaaacattcagggggcgagctgaaatgacaaaatttggctataatttatgttggcccctgacatatatatttttttaatggtttggtctctaagcaactgatctcttagcaacaagaagcacctttataaaagatggcacacgaagagtgattgccagaaaagccacctggttcttaaacagccgcgcatcattagcaaaactcaccatcttcaagagtccaaaaactagaagtgaccagcagacccaggtacccagggattgaagacttaaatgtctttccagaaaattggaattagaaatgagaattgttacttcatctgtactccttcaataaagattgcgtaattataaacccaaaaaaaaagca

SEQ ID NO: 378502 - DNA, 375 bp, Homo sapiens
gcaacctccgcctcccgggttcaaacgattctccaccctcagcctcctgagtagctgggattacaggagcctgccaccatgcacggctaatttttgtatttttagtagagacgggatttcaccatgttagccaggctggtctccaactcctgacctcaggtgatctacccgcctcgacctcccaaagtgctgggattacaggcctgagccaccgtcccgcaagagcatagtttgaaaaaaaacatatttcgtagtactcatatatgttttaattttttttaaaactattgtttccagaatactatctacattaaggcaaagtgagatgaaatcctcttggctggtggagcatgcgttaaaaaccttactatccac

SEQ ID NO: 378503 - DNA, 269 bp, Homo sapiens
gcaaaactccatctgaaaaaaaaaaaaaaaagaaaagaaaaagaaacctttgttttgcacagttccatcttaactgaaactcgtgcatgtcagaaccatgcaaaggttttgatatgcacaggttttatttaatatggtgccatgcaaaagctaggactacttgtatacccaaatgtgaactctgcagttgtatgtaatgttctataagtgttaattaggtcaatttggttagtagagttgttgaagtcttctaaattctcttttttttt

SEQ ID NO: 378504 - DNA, 325 bp, Homo sapiens
aatgtctgctgtttgtaagccacacaacctatggcattctcttatagcagtctgaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtaagactctgtgtca

SEQ ID NO: 378505 - DNA, 366 bp, Homo sapiens
aaaaaaaaaaaaatgaaagaaacttgcccttttactttatatattcccatagtcacacacctagacctctgtttggccagattaccagatatatgtatgcaaagagaatttgtagtgaaaactgtcgagtcatattcaaatcctttctgtaatgaaaagctttttcctaaaatctgttggaaattgctcattggttaactacttctgtaaaagtatttggttgaaattccagagttttatgaggtgaaggataaaaagatggctcaaggcctactaaagtcaacctgcatcattagtccctttcagaagacaagaacctggattatggaaagaatcctgtttctgaatctgctatagtttctctcc

SEQ ID NO: 378506 - DNA, 503 bp, Homo sapiens
caaattgatatttcatataatttgttcattttaaacattgtatgagaaagcaggataaatttgatccctattaattcattttgtctggaagcagaagtcccaggcaaacattttaatatttctgtcttacttttgagagtaattgtagacatcattcttctttacccctaaatacttcagtttgtgctttctaagaacaaaaacattctcagctgggtatggtggctcacgcctgtaatcccagcactttgggacgccgaggcatgtggatcacttgaggtcaggagttcaagaccacactgggtaacatggcaaaaccccatctctactactaaaaatagaaaacttagctgggtatggtggcgcatgcctgtagtcccagctacttgggagactgaagcacaagaattgcttgaacacgggaggtggaggttgcagtgaaccgaaatcatgcccactacactgcagcctgggtgacaaagtgagactctttcaaaaaaaca

SEQ ID NO: 378507 - DNA, 318 bp, Homo sapiens
gctcgacaagcgattctcctgcctcagtctcctgagtagctgggattacagacgtgcaccaccacacccagctaatttttgtatttttagtagagacggggtttcaccatgttggccaggatggtctcgatctcctgaccttgtgatccgcttaccttggcctcccaaagtgctgggattacaggcgtgacgacacgtgcccagcctacattatttattatgattccagtttgcctctctaaatgtacactataatcttaaagcaactacaaaaataatttttaaaaacaggtaaaagtaataaaaagaggcaaactg

SEQ ID NO: 378508 - DNA, 152 bp, Homo sapiens
tcagttcaggtctctggcactactcctggatcactgtgacagaactgagtggttcttccaacttacagggacactcttcttttattggtgacatggggtcaatgatgttggctagatatgagagaaaaacacagtagggcatatatgatggt

SEQ ID NO: 378509 - DNA, 305 bp, Homo sapiens
agcccacgggttccttaccctggggttaggagtccttggatgtatttcagtgggtctgtgaactctatgaaattgtatgtaaagttctgtgtgtatgtgcatttttctgatgagagggtcaccagtttcctttagatcatcaaatgggtcagtgattcaaaaaagctttatgccaggcatcgtggctcacgcctgtactcatagcgctttgggagattgaggcgggaggattgcttgagcccaggagttccagaccagcctgtaacatagcgagacctcgtctctacaaaacaattaaaaaaaaa

SEQ ID NO: 378510 - DNA, 780 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctc

SEQ ID NO: 378511 - DNA, 816 bp, Homo sapiens
ccagtgcaggtgtgagctgccggtgctgcagacccatcacaaacctccccctcaaagaaagcacatccgcctggcagagctcctaagcctcgagcagctgccaggagactcatttcaattaggacacatgtctggaggccaccccaaggtggctggcgggcagagtgaggcaggaggccctgcaattccagggttgcccaggcactgagaatcctggctgtcatcataatgggctgaggttctggggacaatctgagtggcggctctgagcaagctgagcccagggaggctttgaggtacacagggtcccttggggggcctgagagcagccatgaggaggcacagtgagacagatgtggaagagcagacccaggagctgaagaccatcactcagctccagggtgagcctgcaccgccgtgaccagtctccctttcccgtctgggggtttctgggtgcacaactttttgtggggaaaagagagatcagattgttactgtctatgtagaaaaggaagacataagaaactccattttgatctgtactaagaaaaattgtttctgctttgagatgctattaacctgtaactttagccccaactctgtgctcacagaaacatgtgctgtattgaatcaaagattaatgcatttagggccgtgcaggatgtgctttgttaacaatgtgtttgcaggcagtatgcttggtaaaagtcatccccatcctccattcttgattaaccagggacacagtgcactgcagaaagccgcagggacctctgcccaggaaagcctgggaattgtccaaggtttccccccact

SEQ ID NO: 378512 - DNA, 877 bp, Homo sapiens
ggaggctgggggcactctcttgctaaggggctcagggcgtccgggtgggcataggggaggtgggacgtgtccaagcgcccagggtctcactcctccacagccaggtgtgcccagaggagggacaggagaggcggtgaaggaagagggcaggggatcgagccttcacccgcctctgccaccccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctc

SEQ ID NO: 378513 - DNA, 696 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacagttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctc

SEQ ID NO: 378514 - DNA, 871 bp, Homo sapiens
gtcctgcatgatctttccactttttgtttgttcattcgtacttcttttcttttgctgttacatctcctctcttagttggtaagtttctttgtttctttgctgctgtgtatcgactttgtctgtttacttgtgtttctttgatacttgcgtgctcttttttcgttgttttttctcttccttttcccgcgcggggcggcatgaaatcggttgccgggacccccgtggaagatcccggtatgaccccccgacccccttcgggattggttccaaaaacgtccgttccccccggcgtttttatgggggaaaccaagcccagttccaacccgggtttccttgggaaaacctttggcccaggttacaaaacaaggggccccgcccccccaaaagaaggtttaaaaaaattttttcgggcccaagccccccaaaaatttttttttttttttttttttttttttttgtatttttagtagagacagggtttcactatgttggccaggctggtctctaactcctgacctcatgatctgcctgcctccggcctcccagtgttgggattacaggcgtgagccaccgcacctggcctatacttgtagttacaaaaaacaaaccactatagcaaagctatcctgagcacgtatgtacctggttctgggctaaataattccttttacactcaattcatcctgatggcaaccttctgaacgagccatcatcttacaaatggggacacagaggagattaagtaactttcccaatgtcacacagctaaactagctggtcagaagctgccttggccttgaatcctgactctctgaccccaagcccatgtcttgagcccctctgtttcacttcaaagcagaactgtccccaa

SEQ ID NO: 378515 - DNA, 1281 bp, Homo sapiens
tgcgcaggcccgctccccgagccctgccaaccatggtgaacttgggtctgtcccgggtggacgacgccgtggctgccaagcacccggtaggctgcgtccaggtgtctgcggctgggagagaacgcaccctcccgccctgccctgactccccagcagggggcgccaagtcacctgcccgcaggtgctgggggcctggcaaggtgggccctggctatccccgggtacaggttgatggggacctcggctctttgcaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378516 - DNA, 1263 bp, Homo sapiens
tgcgcaggcccgctccccgagccctgccaaccatggtgaacttgggtctgtcccgggtggacgacgccgtggctgccaagcacccgccaggtgtgcccagaggagggacaggagaggcggtgaaggaagagggcaggggatcgagccttcacccgcctctgccaccccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378517 - DNA, 1400 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtgggtgggtactccagggcccctgcctgggctctttgaggggtgggtttctgctagggttggggctgtggttctgcgtccctgactctgacatggagccccaggtctcggcgggagccccacctgagcccacccaccacgtctgtcaggaagtagcctgtgcccggttctcttagcctgggaagcacagaggccccagccctcttccatttcctgctccacagttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378518 - DNA, 2088 bp, Homo sapiens
gggggcatgtgaggaggggctctgctaggacctgtgccctgggctccagtcaccccagcatccggtgggcaggtttcccaccacccaacccgagggcttggcatctgtgagcccacatcctgcagcaggggccccctctggctctccggccagctaggggacacccgggccctcctctgcatacccccctaccacgtcgcctccgaacttggatggccaggaaggggtcccgcggctctctgctcctcgtggaagcagggatctcgctactgggctagcgtgggatacaagaggccctggggagaatgcctggaggagccagcggctgcgggtgcgcaaagggcccgctctagctcagccgccgccgctccgcagtatgaccagtggaccatctccaaggcctgcgggaaaaacttgcctttgcgactggcgcactgccgcagcaccatggaggtaaccaggcaggaggggcctcgagacccaaccttccccacccctgccagcacccccccactagatgttgcggagccgacgagggacggagcaggtgcccagccccaggttccctgtggggttgccacgagcctccacccgcccgcctgctggcgggctccatggcggccccctacgcaaccacgagtgggcggtgcccttcccgacccaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgagcccagcggcccgggaagggcgggggtcaggggctgggatctgggaggggcgggagcgtcctggggcggagccgccccgcacccgccagggagagggagctctgcctgaccaccggctacgcaggacgccgaggcatgtggaaaacgtttttttaaacttcatttttggctattccaaaaaagcatatcgtggggtatatcagaattcttcggactttcttgcacgtattaaatgatttggtattgtttgtatcttgcctgtcattttctcattgcctgggcctctgagagtcagacaggtcctgcaccctcagaaagtccttgcacctttgagggtccgctgggcctgtaagcagggcttgctgccgtcccagccagcccacccgccctgctccctgcagacgaggccaaaggcagccagcagtccgattgtgagggaagacccccttcatgggaggctgagcaccgcccctcgggctgccacaaagcagaacctactccagatgggctgtagatagggagagcacaggaggtgctaagaggagcaacctgtggatggggcggggagccagctggaaacaccctcaccctaagactgggcaaaggggagctctggagagccatgcttcgggaaggtgacagcatggaagtgcagtttaggaggagtggtggacggaggctgcatcgcagctcttttcctgctgtggtcccagcccaggtggctctcagcaccgtcctctgcttgtccctcttgccttggcccctggtcctattggctcacctggaagccctgcccctctatgcttcctgggcccacccctctccccacccctgtccatgcccctccttcgcctgggtgctttctgttcctctggtagcgccttcttctgtttagaacatacacacttaaaaaacaattattcccggcctgggcatggtggctcatgcctgtaatcccagcactttgggaggccaaggcaggcggatcacttgaggtcaggagttctagaccagcctggggtgcgtgagcaggggttagcagatgacggttttagctgcccaagggcacgctggaagaggccaggttttggggaagaggatgaatctgtcttcaggcaggctgaatgcacttccgtgagttctaggt

SEQ ID NO: 378519 - DNA, 1824 bp, Homo sapiens
tgcgcaggcccgctccccgagccctgccaaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagagcagtgtcgggcactccagatccaaggggtgaaagagaatatggaccagaacaaggccacgctggccctcctgcgcagcaacatccgccgcggggcccaggactgggctttggccaagaaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgagcccagcggcccgggaagggcgggggtcaggggctgggatctgggaggggcgggagcgtcctggggcggagccgccccgcacccgccagggagagggagctctgcctgaccaccggctacgcaggacgccgaggcatgtggaaaacgtttttttaaacttcatttttggctattccaaaaaagcatatcgtggggtatatcagaattcttcggactttcttgcacgtattaaatgatttggtattgtttgtatcttgcctgtcattttctcattgcctgggcctctgagagtcagacaggtcctgcaccctcagaaagtccttgcacctttgagggtccgctgggcctgtaagcagggcttgctgccgtcccagccagcccacccgccctgctccctgcagacgaggccaaaggcagccagcagtccgattgtgagggaagacccccttcatgggaggctgagcaccgcccctcgggctgccacaaagcagaacctactccagatgggctgtagatagggagagcacaggaggtgctaagaggagcaacctgtggatggggcggggagccagctggaaacaccctcaccctaagactgggcaaaggggagctctggagagccatgcttcgggaaggtgacagcatggaagtgcagtttaggaggagtggtggacggaggctgcatcgcagctcttttcctgctgtggtcccagcccaggtggctctcagcaccgtcctctgcttgtccctcttgccttggcccctggtcctattggctcacctggaagccctgcccctctatgcttcctgggcccacccctctccccacccctgtccatgcccctccttcgcctgggtgctttctgttcctctggtagcgccttcttctgtttagaacatacacacttaaaaaacaattattcccggcctgggcatggtggctcatgcctgtaatcccagcactttgggaggccaaggcaggcggatcacttgaggtcaggagttctagaccagcctggggtgcgtgagcaggggttagcagatgacggttttagctgcccaagggcacgctggaagaggccaggttttggggaagaggatgaatctgtcttcaggcaggctgaatgcacttccgtgagttctaggt

SEQ ID NO: 378520 - DNA, 742 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctc

SEQ ID NO: 378521 - DNA, 715 bp, Homo sapiens
cctgatggcaaccttctgaacgagccatcatcttacaaatggggacacagaggagattaagtaactttcccaatgtcacacagctaaactagctggtcagaagctgccttggccttgaatcctgactctctgaccccaagcccatgtcttgagcccctctgtttcacttcaaagcagaactgtccccaacctccccgggtttcagtcagccttttctgcagagcatttcatcacaaactctctcagtctctctgggttgttggaccctaggtggtgaaagagtccaccaggccagcactgtccactccctgtgaaacacctttcatcaccgttgtgcccagcggggagtgggggaggtggctggggccacagaggagaacctatcactgttctcagggctcttagtcgggggataaaagctcggggcaactgcagcccactctgtaggggccacaagagaaccccattcaacacaggtgctggcaggataccccattgagctggacaagctgcagaacctcgtggtcaactactgctcagagctgtcggatatgaagatcatgtcccaagatgccatgatgatcacggatgaggtcaaggtgagctcagggcccagggctgggggccccccagggccagccctcttggatcttcggatggggtcaaggtgagctcagggcccagggctgggggccccccagggccagccctcttg

SEQ ID NO: 378522 - DNA, 1180 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378523 - DNA, 713 bp, Homo sapiens
tgcgcaggcccgctccccgagccctgccaaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctc

SEQ ID NO: 378524 - DNA, 1187 bp, Homo sapiens
ccagtgcaggtgtgagctgccggtgctgcagacccatcacaaacctccccctcaaagaaagcacatccgcctggcagagctcctaagcctcgagcagctgccaggagactcatttcaattaggacacatgtctggaggccaccccaaggtggctggcgggcagagtgaggcaggaggccctgcaattccagggttgcccaggcactgagaatcctggctgtcatcataatgggctgaggttctggggacaatctgagtggcggctctgagcaagctgagcccagggaggctttgaggtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtccacgaggaacatgaggcaaagggaaggctccttcatcgaggagcgcggcaggggaacggtcaacagagaaaagtgtcgacagacccacgagggaccgcggaatacgcgggcgagggtggattcctcgaccgtggccggactgatgggggaaaagccccccggatggacccggggaagcgggggggaggcaaggggggcccgggaacgcctgcgaaagaagaaaccaaagcaggaccacgcgaagaggcgcggccctcagaaaagaacaggc

SEQ ID NO: 378525 - DNA, 1113 bp, Homo sapiens
tgcgcaggcccgctccccgagccctgccaaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378526 - DNA, 1096 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacagttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctccacccaagtttccacctgaccaggtgaaaaacaaatcagaagggtaagatgatgacaggtcacatgaaacctttattaccctacagttgatatatgaggatcacatgcaagttacatactgaggatgtacagggaagttcccagcgctgaaccccagaattagacgttcgcatcagccccgtaggccacgtgacaccaccacagcctctctgtatgggggtctgcctctgtagcacttggcatgtaggggcagagcaaaaggggccaggctggccagagcctggctgctgggagaggagggacttgtgggccacgcccacctgcctatcattccccactcatctattagccaaagtcactccccagaggcagagctagcccgttgtagccgtgtctgt

SEQ ID NO: 378527 - DNA, 1947 bp, Homo sapiens
ccagtgcaggtgtgagctgccggtgctgcagacccatcacaaacctccccctcaaagaaagcacatccgcctggcagagctcctaagcctcgagcagctgccaggagactcatttcaattaggacacatgtctggaggccaccccaaggtggctggcgggcagagtgaggcaggaggccctgcaattccagggttgcccaggcactgagaatcctggctgtcatcataatgggctgaggttctggggacaatctgagtggcggctctgagcaagctgagcccagggaggctttgaggtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgagcccagcggcccgggaagggcgggggtcaggggctgggatctgggaggggcgggagcgtcctggggcggagccgccccgcacccgccagggagagggagctctgcctgaccaccggctacgcaggacgccgaggcatgtggaaaacgtttttttaaacttcatttttggctattccaaaaaagcatatcgtggggtatatcagaattcttcggactttcttgcacgtattaaatgatttggtattgtttgtatcttgcctgtcattttctcattgcctgggcctctgagagtcagacaggtcctgcaccctcagaaagtccttgcacctttgagggtccgctgggcctgtaagcagggcttgctgccgtcccagccagcccacccgccctgctccctgcagacgaggccaaaggcagccagcagtccgattgtgagggaagacccccttcatgggaggctgagcaccgcccctcgggctgccacaaagcagaacctactccagatgggctgtagatagggagagcacaggaggtgctaagaggagcaacctgtggatggggcggggagccagctggaaacaccctcaccctaagactgggcaaaggggagctctggagagccatgcttcgggaaggtgacagcatggaagtgcagtttaggaggagtggtggacggaggctgcatcgcagctcttttcctgctgtggtcccagcccaggtggctctcagcaccgtcctctgcttgtccctcttgccttggcccctggtcctattggctcacctggaagccctgcccctctatgcttcctgggcccacccctctccccacccctgtccatgcccctccttcgcctgggtgctttctgttcctctggtagcgccttcttctgtttagaacatacacacttaaaaaacaattattcccggcctgggcatggtggctcatgcctgtaatcccagcactttgggaggccaaggcaggcggatcacttgaggtcaggagttctagaccagcctggggtgcgtgagcaggggttagcagatgacggttttagctgcccaagggcacgctggaagaggccaggttttggggaagaggatgaatctgtcttcaggcaggctgaatgcacttccgtgagttctaggt

SEQ ID NO: 378528 - DNA, 650 bp, Homo sapiens
tgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacacggggtcgaaggggcctgtacactctgtcatttcctttctagcccctgcatctccaacaagtccaaggtgacagctggtgctaggggcgtggggttaataaatggcttatccttctc

SEQ ID NO: 378529 - DNA, 416 bp, Homo sapiens
cttagagttccttgagagacagactgggaagttgggagttcttattgcagctctctttccctcaggtcctcttctgttgtctcccaaggacttgcatttcaggattctagatacatattgtatttctggagcaagacaatttcaatcaggagaagcctatttctagtcattcattcaggacttcagataaaagcctgttttaagcagaaagctgccctgcctctagacctgattataggctcctgaaatctaagccagatatcttcctctttactaactgggttacaaatggacctcacacaacttaaacaccacaaatgaccagaactttaataacattcaccttgacgtgtttcattattggtaaagatgatatgactctgtcttcagaataaatctccagtgtttgaatgtga

SEQ ID NO: 378530 - DNA, 3280 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatccttt

SEQ ID NO: 378531 - DNA, 1000 bp, Homo sapiens
gtaaggagtagcattgctgttggcgcctaacacacagaaaaccaacgaacgaaaagacgtgcctttgaaacatgcgttgctttcagtggaacatctttaacaaacaacagatgtttaatgagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378532 - DNA, 1013 bp, Homo sapiens
gagaagcagccagggtaatgcacagatgctgctggagcgtgagagaatccacaggtcccatgcgtaagactagaggggtagggaggacgactgtggcatttttatatccgatacgacatgccgtggcttgcgcaaggttcgaattgagctgccctcgtgactgctgcctctgtgatctgctatggcaggtggagcctggaacaggtgtctgccttcctctgttgttatgatttgctagcttaccttcgcggcacagtgaccacatgctggcactgagggtggtcatttctcagtgtgtgatctcgcacctttcacatcctgcttttacatctggtaaattttcttcctagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaacaggcttcagggatggctttgcaagatgccactttctgttaagaagtcgttttctcaatttttaaaatatattccaacaaatattttgatctgtgtatctttcaaccaaagataacacaacatttgatttattatcttagaggccgactgttcggtgtatcctgttcagcttaggagggaagtaaaataggaatgggttagtccaaaggagatatagtaaacaaactt

SEQ ID NO: 378533 - DNA, 512 bp, Homo sapiens
gagtcacagaggaagccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcggatcttccccatttcacggagagacatggatgagaatgaaggctgctgagtgggaggggcttatggggccagttttgaagaggcctcataccttttggccacattccattggccagaactttgtcatatgactgcacctaactacaaggaagactgggaaatgtagtcaagttgcatgtccgggtagaaaagggacacttttctgtggaatagctagcatgtttgtaactcaattttataaaccattttgaaacttttctt

SEQ ID NO: 378534 - DNA, 8270 bp, Homo sapiens
  misc_feature (126)..(126): n is a, c, g, or t
gcccgggtgggtggctgcgcagggccctacctgggcgggagcggctgcagagccctgtccacgcggtgcctccccagcacggcacctcccactccaggctgttggttacctggccgggagctggcngagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378535 - DNA, 7789 bp, Homo sapiens
agcggggcgtagggagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcagtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacggggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378536 - DNA, 8195 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378537 - DNA, 8352 bp, Homo sapiens
gagtcacagaggaagccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcggggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378538 - DNA, 7875 bp, Homo sapiens
actatataggcggccgggtctatttcatccgggctgcgtctactgtagcaggtggcgtggcctcatcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378539 - DNA, 8255 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378540 - DNA, 7451 bp, Homo sapiens
acagtttgaaatacctttaagctctacctggtttggcagtggaatttagtagctagaacagatgataatgtttttccctttccctgtgatcaccttggcagcaaccctttacgtttgagactacggggtcttagaaccaagttctgtaagaatttggactctgcaactgtatggggttcatttcacagtagatttgaagctgttggaaatctattgctgttttccagacacttgtaagtgttttctatataaatagatctaattaactttgtctagagaaaataattatctgggtgtaccttactttattaaactgatcagaaaacaaatgcaaggtattaaataataatgatttcttgcacaaacagccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378541 - DNA, 6390 bp, Homo sapiens
  misc_feature (20)..(20): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (45)..(45): n is a, c, g, or t
gaacgtagggacctacgaangntntgntcaaaaaacccgcacggngttttttatatacgagcagtacttacgtctagtacagccgtgcgatcgaacagaaagacagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378542 - DNA, 6279 bp, Homo sapiens
cggcacgaggaggtctcctgtgtaaaggcaaattatacccccaccccggaggaatcagtctgtgatcccagtttgaaaactactgatccacatgattgtgaaccaagcaagatcatttggacaaatctaaaaatggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378543 - DNA, 6236 bp, Homo sapiens
cggcacgaggaggtctcctgtgtaaaggcaaattatacccccaccccggaggaatcagtctgtgatcccagtttgaaaactactgatccacatgattgtgaaccaagcaagatcatttggacaaatctaaaaataatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378544 - DNA, 7988 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378545 - DNA, 6011 bp, Homo sapiens
gagaagcagccagggtaatgcacagatgctgctggagcgtgagagaatccacaggtcccatgcgtaagactagaggggtagggaggacgactgtggcatttttatatccgatacgacatgccgtggcttgcgcaaggttcgaattgagctgccctcgtgactgctgcctctgtgatctgctatggcaggtggagcctggaacaggtgtctgccttcctctgttgttatgatttgctagcttaccttcgcggcacagtgaccacatgctggcactgagggtggtcatttctcagtgtgtgatctcgcacctttcacatcctgcttttacatctggtaaattttcttcctagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378546 - DNA, 3348 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttgg

SEQ ID NO: 378547 - DNA, 4516 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtaaaaaacaaataaaagtttttcgcgcatacctacttatcctgcacgtgtaatcctaatttcctcgagggggggcccggcacccatttcccccaatagggagccgtattacaatacacgggccgttgtatacaacggcttgagtgaaaaaacccgtgccc

SEQ ID NO: 378548 - DNA, 4052 bp, Homo sapiens
gagtcacagaggaagccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcggggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378549 - DNA, 3209 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcggtataccaccaaaaatgtatggttataccttatcctaaaaaggcaccatgcaggcatttaagactgaaccagtgaactctaaatatgtagtagtagaaaatatcactaatcaaaacttccagcatcagatggtacaaaaccccaagaggactggtgacatgtaccccgggatggcaaccccagcttctggcaaccccacagcccagcgggagcttcagctctggtcaggtgcacggctgccaaagtctgcacaccttggggacaaggaaaggagacact

SEQ ID NO: 378550 - DNA, 3197 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaacaggcttcagggatggctttgcaagatgccactttctgttaagaagtcgttttctcaatttttaaaatatattccaacaaatattttgatctgtgtatctttcaaccaaagataacacaacatttgatttattatcttagaggccgactgttcggtgtatcctgttcagcttaggagggaagtaaaataggaatgggttagtccaaaggagatatagtaaacaaactt

SEQ ID NO: 378551 - DNA, 1710 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacggtaatgatccactttatcagacatcaatagcaagaggccgtgaggcagttttaatatttcgtgtagtggtgaatatacgctgtttttaaaaataagattagctcctttgtgctacagagctgcacacgtttcttattttaagcttctcatttggggattgtttaaaggtactgggtaaaatagaatgatttttttagtcccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccagaatgcaccatgaccctttctctgccaccaggggctctcctcacacaatgaacaagtttccg

SEQ ID NO: 378552 - DNA, 576 bp, Homo sapiens
tctgacaaaagtcacttggaaagcatgtttagtttgtgtagtgtaccccaaatggtttctcaaatagcagtatagctgttttcaggggtgaaagctgcattcaaagctgattagccctcatcagttctaggactttcccctgtgctgtgtagacattatctaatttttccatggataatctgagaagtgagaatttacggtttatgactcatgaaattctcttgaatgttgcctcagtatacataaaatttcaggtgtattgtttgcattatctatatttataaatttatcttccaggctgtcccttactccagagaatttaagcagaaatatgactacttcaggaagaaattaaagaaacctgtgagtaatcatgccttccaaaaatgctttgtgttagtcatttgtaagttaccacagtcacttcagtgagaacaacttggttgttacttttatatgaatgctaaaaatattaccttccttttctctctgcactttgatcctcctggttctaaaatctgaattttctttttaacagaaatggtaagtgaaaattaactcagtgttacatatcaa

SEQ ID NO: 378553 - DNA, 620 bp, Homo sapiens
gcctttctagaattgatatatatatatttttttggccttcatttgggaatttactcaaatgtggccccgaagccatggctagagccagagagccccagagcaaggagaagggcatgcagggcatgctgtgatgacctcttactcacagccgaagaaccaacctcataatcgtccctttaactttattccgcagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatgtgagtaccgtgtgatggtcaggaacacgtgcacgtgcactgcacagctagggacaaatatggcggccctttgggacaaggctgggaaataaatcatatgtctataagagcagatggtggtgtggtacgagattcctctccatttacgtaaagcatgcaagagcagtcagaacttgtatattgtaagcgattgcctttgagtcacatgctgctgttttcaatatgagctgatttattttctatgtcttcttttatgtcga

SEQ ID NO: 378554 - DNA, 7707 bp, Homo sapiens
agcggggcgtagggagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcagtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacggggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378555 - DNA, 8072 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378556 - DNA, 4961 bp, Homo sapiens
  misc_feature (4736)..(4736): n is a, c, g, or t
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagcaaagcnaaagggcctgccaagttcatgcagtgagtagccagtttctggaacttgctgcctgaaaaaggaagtaggaaagactggaaatcggttccctagttttagaagtttcaatagcatctgtctacctccattctgaagagggaggttttggtgtcctggtcctctgggaatagaagatccatttgtctttgtgtagagcaagcacgttttccacctcactgtctccat

SEQ ID NO: 378557 - DNA, 2968 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatccttt

SEQ ID NO: 378558 - DNA, 2371 bp, Homo sapiens
tggtattcccccggtatcagcagaggcgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacgtcgaccggccgctaatttagtagtagtag

SEQ ID NO: 378559 - DNA, 8435 bp, Homo sapiens
agcggggcgtagggagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcagtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacggggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtactaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggcgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctaaaaaaaaaata

SEQ ID NO: 378560 - DNA, 318 bp, Homo sapiens
tctcagtcttagaatttatatatgagatatgagtatggtatgaattttggaatgttaccttattttggaaatgtgttttaaagttttctttagattggaatgaactcttttttttttttttttttttttgagaggggtcttgttttgttgcctgggctggtcttgaactcctggcctcaaacggtcctccctccttggtctcccaaagtgcttcgattacaggtgtgaaccacgatgctcagccaaattctcattcttataaatcactgaatcacagactagttcttcagtatcactttattcagtctctatggtaga

SEQ ID NO: 378561 - DNA, 439 bp, Homo sapiens
aaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcc

SEQ ID NO: 378562 - DNA, 1503 bp, Homo sapiens
cgcaggagctaggatggaggaaatcctgccctttggggtggcagggttactgtggcaactcaggcagaagccaaggggctgctgttctggtgtataagggccctgggcccaaccctgcatctgagagacccaagcagaggatcagagaccaggatgctaactttacttggggcaaacaaggcagctcactcactcagtcactctctgatcactcccactctccttggcagcttagcctttaaaaagatgcagttcaggctttggagtcagaggggcctgggatggaaggggataaatgcctggcacagctctgccctacccacccttctgcctacctgctcacaggtgtaccagactcaggacatccacaaagccaagacacccatcacatcccctcccccagagtgtaacacaaatgctctctctgccctgggcacccaagccattccaaggggcagcagcaggcaacagcctcaagcatacagccctgacccagagccgttcctattcctgttcgtccccaacctcacacaatctgcccacccctgctgcacagcaccagagggagccccaagacaggcttggaaggctccatgtaggcagggaaacaggacctatcttcatccacgttccactcacctccacctccaccaccacctccgctgcctcggttccctcggttgcggtttccacggcccccagagccatactgctgctgctgatagacttctttgggctgggccaccttgatctcacactaaaagtcaagaggacagtggtcaggccagtaggacaaactcagggcagtgactgcccaaacaccttcactgcgacaaacatcaaatggtggatcaggtccatttgctgagaaacaaaatatgctagtatgggaggccacctttgggctaaagctcatggaatcccaactaaaaccaaaggccttccagcagagaacccttccgacagaatgcacttgagatgggcatctcagccccagagcaactccgtatctaatggaggcaggcaactgggccaactgcagcccaggggagcagaggacaggctgggaccaggcaccacaccttggtcctgctgggctagagggtcagacaagacttctcagatgaggggccttagacaatgaggttttaacatctttttctctttacagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378563 - DNA, 847 bp, Homo sapiens
aacggctaggtacgaggcccggtttccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctccttcccagccctgtgcacatgtcccctgcatgtctccccacttcctctcctaccctgccctccttaggccctggcctccctcatcttctcctggttcccggagcacactgagctcttttccttcacaaggccttggagcatgctgctccatctgcctggaaacctctccctcaagactcagtacatgagtcacctcccc

SEQ ID NO: 378564 - DNA, 980 bp, Homo sapiens
ttaaacaaaagacatttattttctcacagtcctggaggctggaagtccaagaccaaggtgttcgcagggttggtttcttctaaggcctctctccttggcttggagatggccctggttggtcttctgagtgcaggtgtccctggtgtctctttgtgtgtccagattttctcttataaggacactggtgagattggatgaggggccccctgacggcctcatcttaatgtaatcacctctcttatctccatatccattcacatacgggccattgcgagctaccggggattaggggttcaacacataaattgggggtgggggggtgcagctcagcccataaacatgccccctctggctcgctctcccagggcatccatcgtagcacttagaaaaatgatcacttcttcttttttggctttgtggtggcgtgtgtgtgtgtgtatttgtatatacacacatatatatataaatacacagacacacatatatacaaacacacgcattcattttcgtccacagttcctggctcataactcccacagcccttgttacactcttttgttacaacattgggtgtgtcaggcctcaggagacaatcactctaacctcctgcccttccttttacctgcccaagacaggactctaatcttccctacctttctgatggtgggtcataaaactcattccagagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagttttgtgagccaactccagcccgggcaacagagtgagactgtctcaaaaa

SEQ ID NO: 378565 - DNA, 1279 bp, Homo sapiens
aagaaattccaaaggtggccagcatggtggctcatgcctgtaattccagtactttgaggccgaggtgggaggaatgcttgagcccccagtctgggcaatatagtgagaccccatctctgcaaaaaaagaagttccagaggcccagacttgctactggtgcccagggggctgtggggcagcttgggcattgagccctcatgctgtgggatctgatgctgtctctaggtagatagtgttggaattgaattggaggacacccaactggtgtccgctgcagaactgattgcttgcctggtggtggggagaaatccttacatattttttggagtcacagaagtcttctgtgttgattgttgtagtgtgaaagcagaggaaaaacaatggtttgggttttttcaaaacaactttcatgacacatacgagaatgtaaattccagaagggccaaggccatgtctgttttacctactctttttcccccagcttctagtacataggaggcatttgatatataccaaacaaacaagcaagtgactgactagttgatgtcctgagaatcttcttgctgctggaagggtcctcctgccctcagcatttctctctgggaagctcttagactactctctcagtcatgcccaccttttcggtcataggtcagaagccaatgacctggccctgaggctggctcgccactacacgggacaccaggacgtggtggtattagatcagtaagtgcaactcacagccctaccgttcccagaagcctggcccacaggcttcttggtgatccgtgagactgactctgggtgccttaggcagggaggataaggggcctgggctactgaagacaagtgtggcaggcagaggaccaggcctgagacctcccagaggctctgtcaccctgggccaccattctgggaaggcagctctggggagcagagtgcgctttgtaagagactcaaaggtggtcccacaacattgtacatgttcaaactactccagcagtagctcccatgaattgagtatgtgatgtgcacaaagccggggctgacaatatcaacacatttaagattcattataaaccagaaggaggaaatcccacctcatttcacagcagagaaaacaaccgagagagattaaatgatgagctgctgtcacatagccagtcagcagtcttgcaagaattgttgctgactccaaagcttgtgctctttcccagcccaagaacttgggggctctgtcaggaaagttggcctcccttgtgtgtcttcaggggtgggg

SEQ ID NO: 378566 - DNA, 2747 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacggtcagtatcacacctcaggctggcagggcaggagaggaaggcagtgctgtgaacctggtcccaaggtgacctgagattgccgagaggtgtggagaacctgggtggagttgaggcactgtcagtatgcagaggaggctcagccttcgcaatatagctgtggaattctgcaatctggagctgtgctaaaccaggcaggggtcagcaatctaggtctgtgagtctagttccacttgggactgatgatgagctcacaaagtggcagatggcccagctgtgaccagcaacgtagcacagtgctggccaagtgctggggtcatggcagtgcttcagccccattggccatctcaggtgctaggcaagggagctgaagtaggaattcagtcatcttgatgaggctgccagagctgatggaaagaaagggagtctgagactcagcaggcacatggaagatgaataaagttgaggttaaaaaaaaaaaaaaagcagagactctagtcttagactgcttgggctcaaatccctgtcccctacttactaacttgtgatctcgggcaagttacttaattctcagtgcctcagtttgcttatctgtgaaagacataatgatactaggtacccactttaaggtgtttggagaattaagtgtgttaatttatgtagcttgctctgaatgtgcctggcacatggtgagctctcagtacatattcactgttattatccttggcctttgacaatcaagattaccaccagcccccttggctggtgaagtgaaaccagttgacagtcaccccccaccccacctttgtcatacaagcctcaaaaggccttccagcctgggcaacataatgagaccttgtctctaccaaaaaaaaacttaaaaattagccaggcatggtgactggtgtctatagccccacctgctcaggaggctgaggtgggaggaccacttgagcccaggagtgtgaggatgcagtgaatgccatgatcacaccatacactccagcctgggtgacagagtaaggccctgttaaaaa

SEQ ID NO: 378567 - DNA, 2740 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacggtcagtatcacacctcaggctggcagggcaggagaggaaggcagtgctgtgaacctggtcccaaggtgacctgagattgccgagaggtgtggagaacctgggtggagttgaggcactgtcagtatgcagaggaggctcagccttcgcaatatagctgtggaattctgcaatctggagctgtgctaaaccaggcaggggtcagcaatctaggtctgtgagtctagttccacttgggactgatgatgagctcacaaagtggcagatggcccagctgtgaccagcaacgtagcacagtgctggccaagtgctggggtcatggcagtgcttcagccccattggccatctcaggtgctaggcaagggagctgaagtaggaattcagtcatcttgatgaggctgccagagctgatggaaagaaagggagtctgagactcagcaggcacatggaagatgaataaagttgaggttaaaaaaaaaaaaaaagcagagactctagtcttagactgcttgggctcaaatccctgtcccctacttactaacttgtgatctcgggcaagttacttaattctcagtgcctcagtttgcttatctgtgaaagacataatgatactaggtacccactttaaggtgtttggagaattaagtgtgttaatttatgtagcttgctctgaatgtgcctggcacatggtgagctctcagtacatattcactgttattatccttggcctttgacaatcaagattaccaccagcccccttggctggtgaagtgaaaccagttgacagtcaccccccaccccacctttgtcatacaagcctcaaaaggccttccagcctgggcaacataatgagaccttgtctctaccaaaaaaaaaaaaaaattagccaggcgtggtggtgggcacctgtagtcccagctactcaggaggctgaggcaggagaatggcgtgaacccgggaggtggagcttgcagtgagccaagatcatgccactgcactccagcctgggcgacagagtgagactccgtct

SEQ ID NO: 378568 - DNA, 2283 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378569 - DNA, 3106 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378570 - DNA, 2029 bp, Homo sapiens
aagaaattccaaaggtggccagcatggtggctcatgcctgtaattccagtactttgaggccgaggtgggaggaatgcttgagcccccagtctgggcaatatagtgagaccccatctctgcaaaaaaagaagttccagaggcccagacttgctactggtgcccagggggctgtggggcagcttgggcattgagccctcatgctgtgggatctgatgctgtctctaggtagatagtgttggaattgaattggaggacacccaactggtgtccgctgcagaactgattgcttgcctggtggtggggagaaatccttacatattttttggagtcacagaagtcttctgtgttgattgttgtagtgtgaaagcagaggaaaaacaatggtttgggttttttcaaaacaactttcatgacacatacgagaatgtaaattccagaagggccaaggccatgtctgttttacctactctttttcccccagcttctagtacataggaggcatttgatatataccaaacaaacaagcaagtgactgactagttgatgtcctgagaatcttcttgctgctggaagggtcctcctgccctcagcatttctctctgggaagctcttagactactctctcagtcatgcccaccttttcggtcataggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378571 - DNA, 2004 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378572 - DNA, 3216 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagaatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378573 - DNA, 2325 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378574 - DNA, 2192 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggtatgcactgcccaactcaacaacagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378575 - DNA, 1700 bp, Homo sapiens
atccttgggcagtactgactgatgggttgagggaggaggcgtggatcaaaaatggggggcagggaaggaactggcttatggtggaaaaatcagtgcatgtagttggggcatgccaagtactaggggcctggaggcatccaggtagtaagagttggctggaggcctgagagaaaactgagtcacaaaccttcagatgtaacatggaacccaaagtaggggtgcagcactgatggtgacttgtcttgcttggactaagccagcactagcagggcacgctaagccggtcactgcacaaccccatggtcgtgttcccaatgtccatctcttcacagattgcagccttcttcgctgagtctctgcccagtgtgggagggcagatcattccccctgctggctacttctcccaagtggcagagtgagtaggtgggcggggtctgctctagggagggcaggggtctaatgaggttttccaacctctggtccaaatcccaacctcagcctgtcctgactgccagaattttgagacaaagcccttaaagaaagaatggcccagagaaggccagccattgcccaaggtccccaccttactgctggcagagccagggtgcaaagccccgagacctcctgggtcctgatcttatcctctcaaccacagcccccgtgtcagtcatctcctctgccacaggcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378576 - DNA, 2152 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaagacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378577 - DNA, 4259 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaaaaaaaaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgcttagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagttttgtgagccaactccagcccgggcaacagagtgagactgtctcaaaaa

SEQ ID NO: 378578 - DNA, 2358 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccaggtgagtgggccttgcttcttactcttgaagatgcacagcgggttccttaccatcagcagcaagcagcctcggcaagctgagcctttttttaagacttttttttgttctgactgatgctccttcccaaaggttagtttcttcaacactggaaattctccaatgcttagcttgcacttgatggcaggaacagctatatcctcccttgaaacctatggggctgtatccacgtggaaccccaacccacccttgcctcttgtaaccacctagtcttatgccctaaataccagacctggagttgggctccaatccagccaataaacatcccctgccagagcaggcttttcttcaccagccaggaggagcactattgtgccccaattcagacggccctggcactgccctagtgt

SEQ ID NO: 378579 - DNA, 875 bp, Homo sapiens
ataaggatccccgtgagatgacagtcggccaggcaggggtcagcaatctaggtctgtgagtctagttccacttgggactgatgatgagctcacaaagtggcagatggcccagctgtgaccagcaacgtagcacagtgctggccaagtgctggggtcatggcagtgcttcagccccattggccatctcaggtgctaggcaagggagctgaagtaggaattcagtcatcttgatgaggctgccagagctgatggaaagaaagggagtctgagactcagcaggcacatggaagatgaataaagttgaggttaaaaaaaaaaaaaaagcagagactctagtcttagactgcttgggctcaaatccctgtcccctacttactaacttgtgatctcgggcaagttacttaattctcagtgcctcagtttgcttatctgtgaaagacataatgatactaggtacccactttaaggtgtttggagaattaagtgtgttaatttatgtagcttgctctgaatgtgcctggcacatggtgagctctcagtacatattcactgttattatccttggcctttgacaatcaagattaccaccagcccccttggctggtgaagtgaaaccagttgacagtcaccccccaccccacctttgtcatacaagcctcaaaaggccttccagcctgggcaacataatgagaccttgtctctaccaaaaaaaaacttaaaaattagccaggcatggtgactggtgtctatagccccacctgctcaggaggctgaggtgggaggaccacttgagcccaggagtgtgaggatgcagtgaatgccatgatcacaccatacactccagcctgggtgacagagtaaggccctgttaaaaa

SEQ ID NO: 378580 - DNA, 2323 bp, Homo sapiens
cgcaggagctaggatggaggaaatcctgccctttggggtggcagggttactgtggcaactcaggcagaagccaaggggctgctgttctggtgtataagggccctgggcccaaccctgcatctgagagacccaagcagaggatcagagaccaggatgctaactttacttggggcaaacaaggcagctcactcactcagtcactctctgatcactcccactctccttggcagcttagcctttaaaaagatgcagttcaggctttggagtcagaggggcctgggatggaaggggataaatgcctggcacagctctgccctacccacccttctgcctacctgctcacaggtgtaccagactcaggacatccacaaagccaagacacccatcacatcccctcccccagagtgtaacacaaatgctctctctgccctgggcacccaagccattccaaggggcagcagcaggcaacagcctcaagcatacagccctgacccagagccgttcctattcctgttcgtccccaacctcacacaatctgcccacccctgctgcacagcaccagagggagccccaagacaggcttggaaggctccatgtaggcagggaaacaggacctatcttcatccacgttccactcacctccacctccaccaccacctccgctgcctcggttccctcggttgcggtttccacggcccccagagccatactgctgctgctgatagacttctttgggctgggccaccttgatctcacactaaaagtcaagaggacagtggtcaggccagtaggacaaactcagggcagtgactgcccaaacaccttcactgcgacaaacatcaaatggtggatcaggtccatttgctgagaaacaaaatatgctagtatgggaggccacctttgggctaaagctcatggaatcccaactaaaaccaaaggccttccagcagagaacccttccgacagaatgcacttgagatgggcatctcagccccagagcaactccgtatctaatggaggcaggcaactgggccaactgcagcccaggggagcagaggacaggctgggaccaggcaccacaccttggtcctgctgggctagagggtcagacaagacttctcagatgaggggccttagacaatgaggttttaacatctttttctctttacagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtgtcccagtcatacttttaattggcaaattaaaataatgcaatctgatatattctatcctactaaattaaaaatactgaatataaccaactaaatatacttactcctaagactcactaccagtagtttcacttaaactctgccttagaggctcttcccacccatttcccattatggcacatagagaaaaaggcctctatcactgtccactggagtaataaccactgcttcccctaactgcctcaaagactgtcattttatagttccaggagttccacctgtcccaccttatctggctgccaactcctgctcagaaacagaacctgccacaccctgccactgcaggccgcaccctcaactcccaactgccaacttgaagcctgaactaccctttccctgaccagagttcaggaggggaagagctacacctccctgcacatgaatccactcatttgaaagcacaactgaccctggatttaagctggccaggaccctgggagatctttggaaggatttttgcctgggtttagggttaacttaaagaggtgcccagaagaccaagtgaggcagttcatgcctgtaatcccaacactttaaaaggccaaggcagaggatggcttgagcccaggcaacatggtgagaccaggctttaaaaaaacatatgagccaggcatggtggtacatgcctgtggtcccagctactcgagaggctgagatgggaggatccggtccgcccatgaggtcaaggttgcagtgagccatgattgtgttaccgcaccccagcctggacaacaaagcaagactctgtctcaaagcaaaaaaa

SEQ ID NO: 378581 - DNA, 884 bp, Homo sapiens
ctgctgaagcggctttccttctgccagaatctcaggaactcctggatctgcctttccagaaccagcttctctctccctgctctgccttcagactgccctctttctacctctccctctagaactacatctcttctggctgggtttatagcttggggctgggggaggcccagtgggactggctgagtggagccagccgtgtgacggaggcggccctcttccagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggggtgttgggctcttcattggtgtggatctgatcaaagatgaggccacaaggacaccagcaactgaagaggctgcctacttggtatcaagacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378582 - DNA, 1661 bp, Homo sapiens
taatttcagtcgctgaggccctggcgctttcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctccttcccagccctgtgcacatgtcccctgcatgtctccccacttcctctcctaccctgccctccttaggccctggcctccctcatcttctcctggttcccggagcacactgagctcttttccttcacaaggccttggagcatgctgctccatctgcctggaaacctctccctcaagactcagtacatgagtcacctcccc

SEQ ID NO: 378583 - DNA, 2501 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcagtaagtgcaactcacagccctaccgttcccagaagcctggcccacaggcttcttggtgatccgtgagactgactctgggtgccttaggcagggaggataaggggcctgggctactgaagacaagtgtggcaggcagaggaccaggcctgagacctcccagaggctctgtcaccctgggccaccattctgggaaggcagctctggggagcagagtgcgctttgtaagagactcaaaggtggtcccacaacattgtacatgttcaaactactccagcagtagctcccatgaattgagtatgtgatgtgcacaaagccggggctgacaatatcaacacatttaagattcattataaaccagaaggaggaaatcccacctcatttcacagcagagaaaacaaccgagagagattaaatgatgagctgctgtcacatagccagtcagcagtcttgcaagaattgttgctgactccaaagcttgtgctctttcccagcccaagaacttgggggctctgtcaggaaagttggcctcccttgtgtgtcttcaggggtgggg

SEQ ID NO: 378584 - DNA, 646 bp, Homo sapiens
aaccactcaaaacacacaactacatggatattgaacaacgtgctcctgagtgacttctgggtaaataataaaattaaggcagaaatcaagaagctctttggaaccaatgagaacaaagagacaatgtaccagaatctctgggaggcaactaaagcagtgttaagaggtaaatttatagcactaaatgcccacatcataaaagagcacgttacccacattcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgcttagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagttttgtgagccaactccagcccgggcaacagagtgagactgtctcaaaaa

SEQ ID NO: 378585 - DNA, 412 bp, Homo sapiens
cccaatctctaaactgtcctccagtttggacactgaagtcaacagggcatcttcagcagagaaaggtgactgagtcggcattgctttgtggtctttttcagacatggaagagaaggtgagaagttgtgaaacgctgaggctccagccctaagccagccctgctctgcctaagtgtactccaggtgagtgggccttgcttcttactcttgaagatgcacagcgggttccttaccatcagcagcaagcagcctcggcaagctgagcctttttttaagacttttttttgttctgactgatgctccttcccaaaggttagtttcttcaacactggaaattctccaatgcttagcttgcacttgatggcaggaacagctatatcctcccttgaaacctatggggctgtatccacgtg

SEQ ID NO: 378586 - DNA, 468 bp, Homo sapiens
taaaaatactgaatataaccaactaaatatacttactcctaagactcactaccagtagtttcacttaaactctgccttagaggctcttcccacccatttcccattatggcacatagagaaaaaggcctctatcactgtccactggagtaataaccactgcttcccctaactgcctcaaagactgtcattttatagaaaatttaagactatcctaatccactctttccaaactcccagccaggatagagacttccaggagttccacctgtcccaccttatctggctgccaactcctgctcagaaacagaacctgccacaccctgccactgcaggccgcaccctcaactcccaactgccaacttgaagcctgaactaccctttccctgaccagagttcaggaggggaagagctacacctccctgcacatgaatccactcatttgaaagcacaactgaccctggatttaag

SEQ ID NO: 378587 - DNA, 1866 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgtgcgtatcacggccacctgagctccctgattgacatcagtccctacaagttccgcaacctggatggccagaaggagtgggtccacgtggtatgcactgcccaactcaacaacagattgcagccttcttcgctgagtctctgcccagtgtgggagggcagatcattccccctgctggctacttctcccaagtggcagacagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378588 - DNA, 3251 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378589 - DNA, 3292 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggtatgcactgcccaactcaacaacagtgacatgctcagttctctgggttgaggcatcatcaccctggtggccatgtggaggatggactggaaaaggcattcagttagaagacctctgcaggagtccaaggaagaaacaggcaaatctgcaggaggcagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378590 - DNA, 2758 bp, Homo sapiens
aagaaattccaaaggtggccagcatggtggctcatgcctgtaattccagtactttgaggccgaggtgggaggaatgcttgagcccccagtctgggcaatatagtgagaccccatctctgcaaaaaaagaagttccagaggcccagacttgctactggtgcccagggggctgtggggcagcttgggcattgagccctcatgctgtgggatctgatgctgtctctaggtagatagtgttggaattgaattggaggacacccaactggtgtccgctgcagaactgattgcttgcctggtggtggggagaaatccttacatattttttggagtcacagaagtcttctgtgttgattgttgtagtgtgaaagcagaggaaaaacaatggtttgggttttttcaaaacaactttcatgacacatacgagaatgtaaattccagaagggccaaggccatgtctgttttacctactctttttcccccagcttctagtacataggaggcatttgatatataccaaacaaacaagcaagtgactgactagttgatgtcctgagaatcttcttgctgctggaagggtcctcctgccctcagcatttctctctgggaagctcttagactactctctcagtcatgcccaccttttcggtcataggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagacagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtgtcccagtcatacttttaattggcaaattaaaataatgcaatctgatatattctatcctactaaattaaaaatactgaatataaccaactaaatatacttactcctaagactcactaccagtagtttcacttaaactctgccttagaggctcttcccacccatttcccattatggcacatagagaaaaaggcctctatcactgtccactggagtaataaccactgcttcccctaactgcctcaaagactgtcattttatagttccaggagttccacctgtcccaccttatctggctgccaactcctgctcagaaacagaacctgccacaccctgccactgcaggccgcaccctcaactcccaactgccaacttgaagcctgaactaccctttccctgaccagagttcaggaggggaagagctacacctccctgcacatgaatccactcatttgaaagcacaactgaccctggatttaagctggccaggaccctgggagatctttggaaggatttttgcctgggtttagggttaacttaaagaggtgcccagaagaccaagtgaggcagttcatgcctgtaatcccaacactttaaaaggccaaggcagaggatggcttgagcccaggcaacatggtgagaccaggctttaaaaaaacatatgagccaggcatggtggtacatgcctgtggtcccagctactcgagaggctgagatgggaggatccggtccgcccatgaggtcaaggttgcagtgagccatgattgtgttaccgcaccccagcctggacaacaaagcaagactctgtctcaaagcaaaaaaa

SEQ ID NO: 378591 - DNA, 2128 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtgggatactttaaagtgctcctgcttaaataaattagaccagaccagtgtatttctaaagaaaatcctgacatgcacacccattaaaaatagtacattttacagtg

SEQ ID NO: 378592 - DNA, 4354 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaaaaaaaaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctccttcccagccctgtgcacatgtcccctgcatgtctccccacttcctctcctaccctgccctccttaggccctggcctccctcatcttctcctggttcccggagcacactgagctcttttccttcacaaggccttggagcatgctgctccatctgcctggaaacctctccctcaagactcagtacatgagtcacctcccc

SEQ ID NO: 378593 - DNA, 4230 bp, Homo sapiens
  misc_feature (674)..(674): n is a, c, g, or t
  misc_feature (4177)..(4177): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaaaaaaaaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctcctggcctgcgctgtccctctgnccgaggttaaggctccgaggtaaggcctccgaggttaaggctccgaggtaagg

SEQ ID NO: 378594 - DNA, 2239 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtccacgtggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccagaagaaactcatctcatccaaatacacgctattgagaaggcgagcctgacctccctcttacagataaagtcagctttcagaggctcagggtgggggggcctgcccgaggccataatgctacccaccccctcctcctaaccactggtctgttggaataacccagatgtctgcatcccctcaagtcagtcaatttcctttctgtccactgggggtggaatggggtagggtagtgtatttctaaagaaaatcctgacatgcacacccattaaaaatagtacattttacagtg

SEQ ID NO: 378595 - DNA, 3048 bp, Homo sapiens
  misc_feature (674)..(674): n is a, c, g, or t
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcaggtacccgggcggggggcgggcggcggggggcgcggggctgcgcggagnggcacgcgcacgcacgacgcacgcacgcacgcactacgcacgcgcctccggctaggaagccgctgctacccatcccgtccggccgctgccccggccccgctggagcttctagggcccgaggcgggcggcgccgttgggcagtcccggcgggtggtctccggggccgcctccccgacagcgccgtctccaggccgcccagttcaggagacggccccgccctcaccgctgttcggctgtgtcagcctcgcttggcagcctttactccggagaagaccttcaccctggcgcctgagaggacctcacccagggtggcccgtcagcagcacctgggcctggctcgagagtgacctgggagggggctgaaagggcagacaagggagagtcgggggagtcggttcacaggcagcacacttgacctgtgagggggccctcggtgggacggtgggtgaggtcgcctcccactggagcttagggctggcacccagcgaggggcagcaggaccacgtggctggcaaggagctgtttagggctgagagccaggcacctaatgttggtgccctgtcccatcccatcgaagacacgcggccttatggagtccccatgggacggggcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaaggcagggaagcagcaccttgcccttccagctctcatttcccccccgccaccagaaactgggaaggggtgggcgggggtctgcgatgagtagacttcaccctttcggtcttcagacatggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaaaaaaaaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaccttttctcaggatccgggagactgacgcggacacatgcagaaatgagcaaggaggccacagaggctgaaaattgctttcagaaacaatccgaagtttcagcgacttgttaccccatctgcttcctgctttgcaaccacctgtggagtggagagac

SEQ ID NO: 378596 - DNA, 1199 bp, Homo sapiens
tcttcctgctgccccttcatggggctgggaaaacctaagacctgcttctcccaccctgaggcccctactgtgtaccaggcccgggtaaggtaccagtcacatactcgcacttaggcctcacagttcatcccattttatgcacaaggcgactcaaagactgagtctggcccagagaaggcctgcaggagctccgagccccgcctgggcgccgggagcaggggcggggtcgtccgggaccctttcccggaagggaggccgcaggggcctgcggggcggggcctgcggggcgaggcccggggcgcgtcccggaaccagagacggggcagcgctcgagttcctgcgcgggactgccaaggcacgaccacgggccggaaggctgccaggcccagtgggcaagcgaagaaatgaaccaccgcaacgcgggcgcttcggggcggggccgagtgcgaacctgagccccaaatcccgacccaggcaggggcggggcccggagcggggccttggaggcccagcccgcgcggcgacgtctccgcgtggcgtcacggcaccgactgacggccacccaccatggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctggagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagttttgtgagccaactccagcccgggcaacagagtgagactgtctcaaaaa

SEQ ID NO: 378597 - DNA, 424 bp, Homo sapiens
ctgccagggcatctgacatgttctttgtccctggctcagtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggtgaggctctgggggcagcagtcaccacccacctgccaaggcccagtgtggtaccattttcttcacctcctaacaacctgggatggtggggttatgtccgctctcaagaggaactgagacactgagaggtgctattgcccaaaacggctctcctggggaggagaaagctaggacatgacctgatccctagctacccctgagcctctctcctctgtccacaccaaagatct

SEQ ID NO: 378598 - DNA, 1188 bp, Homo sapiens
tgagttgatctatgaacattattcactatgacccagaaaatcccacgaagtcgtgcatgttagaaggatgaaaccctcatgttcactgtaaactgtgaaggtgctcaggccatcacaggtatgcctatatgaaaagccaccaagtatctgaaatattttcttttacagaaattatgtgtaccatttcagtcttagaaagtggagttggtcgctgtacgcaagacagacattggggctggactcaccatcagtggccccgaaaaggtactgaaatttgcttacaagtgcagagttatgctgaacttaagggtatagatgtagattccctggttattgagcacatccagggaaaaggcacccataatgtaccacctgacttacagaactcatgggcagatgaacccatccacaaactcccctgccacatccagatgatgcttagtgaaaagaaacaccttgttccaaaagcagaaaaggaggatgcacggaagaaaaagataccccagaagaaacataaacttaagagacaaacaaattcagccaaaagaaaatgcaaataaaagttcaaaacaaaacaaaacaaaaaaacctctaaaattcataaaacacaaaatgacaaactctattaaatatgcccctatgatatctcttagataaaagttggccgtaatagagaaaatgaagataggtgttggtgactggcagattctgggtctacgatgaatcagagaaggatggttttcactttgttttacatttttttaatgcttgatgttgacttggtagaaagatgataataaagagattcttctgtctatgtgtttcttttagattactcatgtggactgaagaaaaaaaattaaatttgttaaagaaagtgagtttgatttaggattgtgactgaggacaatagcctggaagcagttctgacagatggctgctatgtaatattttggttcacagtttataagagacatgtgggccctgtgctctatcttgttttttcttcaaagcataattctggagagctggagagtcccagagtcaggaatgttataaagtcaggctggaaaccagaaataagtaacatgactaaacatttgtgtgtttttttgttttgttttgagacagagtctcgctctattgcccaggctgtagtgcagtggtgcaatctcggctctctgcaac

SEQ ID NO: 378599 - DNA, 1232 bp, Homo sapiens
  misc_feature (2)..(2): n is a, c, g, or t
  misc_feature (4)..(4): n is a, c, g, or t
  misc_feature (6)..(8): n is a, c, g, or t
gncncnnnggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttcagaaaaaaatggaaagatcagaaaattgaagatgagtacaaaaatcccaggagaaacctaagtcttagaaagtggagttggtcgctgtacgcaagacagacattggggctggactcaccatcagtggccccgaaaagaactcatgggcagatgaacccatccacaaactcccctgccacatccagatgatgcttagtgaaaagaaacaccttgttccaaaagcagaaaaggaggatgcacggaagaaaaagataccccagaagaaacataaacttaagagacaaacaaattcagccaaaagaaaatgcaaataaaagttcaaaacaaaacaaaacaaaaaaacctctaaaattcataaaacacaaaatgacaaactctattaaatatgcccctatgatatctcttagataaaagttggccgtaatagagaaaatgaagataggtgttggtgactggcagattctgggtctacgatgaatcagagaaggatggttttcactttgttttacatttttttaatgcttgatgttgacttggtagaaagatgataataaagagattcttctgtctatgtgtttcttttagattactcatgtggactgaagaaaaaaaattaaatttgttaaagaaagtgagtttgatttaggattgtgactgaggacaatagcctggaagcagttctgacagatggctgctatgtaatattttggttcacagtttataagagacatgtgggccctgtgctctatcttgttttttcttcaaagcataattctggagagctggagagtcccagagtcaggaatgttataaagtcaggctggaaaccagaaataagtaacatgactaaacatttgtgtgtttttttgttttgttttgagacagagtctcgctctattgcccaggctgtagtgcagtggtgcaatctcggctctctgcaac

SEQ ID NO: 378600 - DNA, 1681 bp, Homo sapiens
  misc_feature (2)..(2): n is a, c, g, or t
  misc_feature (4)..(4): n is a, c, g, or t
  misc_feature (6)..(8): n is a, c, g, or t
  misc_feature (1588)..(1588): n is a, c, g, or t
  misc_feature (1590)..(1591): n is a, c, g, or t
  misc_feature (1599)..(1599): n is a, c, g, or t
gncncnnnggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttcagaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatggtaaaaatgtgtttccctcaaatcatgggaaccatcgcaaaattattctgaagcttctgcagtcactgtcatttgacagcattcagaaataaatgccagtagcccaggagcaaaaatttttgggagtagtttagctggggcctcactcagatacctaggacacagagttggaaataactcttaagagagacacacctccagtaagaccttaagacagttctgtcataaaaaaaatacgaggtttggccgggtgcagtggctcatgcctntnntcccagcnctttgggaggccgaggcaggcggaccacgaggtcagtagttcgagaccagcctggtcaatatggtgaaaccccatctctact

SEQ ID NO: 378601 - DNA, 1063 bp, Homo sapiens
aatgatacattttcatgcactctcattgcaacttcatagtttctaacatttattcttctggggtccgctttggttctctcatttgacgtcatcttttttggcttcatccagctgattcacattggtagaaatacttttctatgttacttgtagtcatgtgaaacctaatctcacccttgcaatctggactgcatgttttatagaatctatattgtgatttttcatgtgtatattcctgtcatgtttgtttgctaaccaaaacaagagcaaagcaacccaaagcctaatgggtaacaatttcaagggcaagcacgaagatttcagctggatacaaacactgcatgattgatggtaggctgtgtcatatttacctgtagtcaattatgtgttccttttgctttgtagtgtctcctgagcaaccgcctttattcacggtaaacatattttctttaattattaacaaaatgctctgtgatatatacatgatatgttaatcattatgttgtcaaacccattcagcatacggtgaaagacagagatcacatttcaactagattcttaggaggtatggattcactaacttccagtgaaggtaaatttgccgctacaaatttcgttctagaaaatgtagatgaaaatattgaaaatgctcatagttttttgattcccactttttatccaagtgagatggaaggatttgatgtaaatatgctgatgttcttgttaatatctttgtttataaaatgatttttaaggcataaggcggacattttacacggtgagctctagcccaaatgcttttcctttaaagttgtcatcagctaaagatcccagttttgaattcctgtgcatgttagggatttgaggaggtgtattttgacactaaatattttcagtgcttcaaaattgattgcaatactcttctgtcttcttcatctagagaaaagctatacctgctgactttacaattgttttagaacttcaacgcctttatttcagcgttgttacattgagaatcttaatcacatcttctgattaccggattgagtttctgcatgtgtgt

SEQ ID NO: 378602 - DNA, 1522 bp, Homo sapiens
aggcaagaattcggcacgaggaagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataa

SEQ ID NO: 378603 - DNA, 703 bp, Homo sapiens
gcgcctccaggccctggaggcgggcagggaggactgggggctcagtgagctgggcaagaaggctggcgtgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataa

SEQ ID NO: 378604 - DNA, 421 bp, Homo sapiens
tcctcagagccatgctggcagccctgggaggaaagctcagtaactgcccactggggaataatgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378605 - DNA, 3063 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagagatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378606 - DNA, 2935 bp, Homo sapiens
aggcaagaattcggcacgaggaagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378607 - DNA, 2833 bp, Homo sapiens
caacgagaggcggctctatggccttgaggtccccggagagagggttgccaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378608 - DNA, 1729 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataa

SEQ ID NO: 378609 - DNA, 3157 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378610 - DNA, 4032 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaacctcaggtgaataggaaaggggaaagtaaggctggagtgatgatggggaggtcggaggataagggggggctgggattgctaatggggactaaaatggccagtctcctggcaagattttgagcaggtcatttcattgaggcctcttagatttcatatttgagaattagggcactgattcctgactggctaggcatggtggtcactggcttgagtcagaccaggaatgtctcttagaaatggtcactgataggcatccttctcctccagtcaggaggggctggtttccttatctgttgcagtctcgactgccagagggaggcgagcgtggtaggcagtcgggggtcccttgtgtttggggggcccagctcccgcttcctttgagcccggaaccaatgatccgaagccttctttcctgatgggattctttagcgaggacactaccgaggcgcgacttcctgacgcgcatccgatccgggaaggcgcacttccgctccccagttgccgcgggatggcaagccggcgtgggggaagggagaggtcggcggagacgagggagggaccatatccgggagagcggcagcttccgaccagtggtcgcgcttccggagaggcgcttccggtggcggcggcagcagcggctgtggtggttccgggtgtctttgtccccccggtgtcgctgcctggcccgcaggtgggttggggggccccctgccgcccctctgccccttcgcccctccgcccctccgctggccgaggggctgcgagggccgggcggcgaagatgcgtggggcgcggaaggggccgagcccctctttggactgcaagtcccgtctccctggcaacggcct

SEQ ID NO: 378611 - DNA, 2579 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378612 - DNA, 1446 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccaccccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataa

SEQ ID NO: 378613 - DNA, 771 bp, Homo sapiens
atattaggaaaatattaggtataatttgagacaggtctcactcagtactctggctggagtgcagtggtcaatctcggctcgctgtagccatgacctcctgggctcaagtgatcctcccacctcagccttccaaagtgttgggattataggcatgcaccaccgcacctggccctacccttcatactttagtattaatgttttagtatatttgccttaaagtttaatgacattctccttgctacctgtccacaatacattccatccattcagaaaattacactgaccacggaggccgttgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378614 - DNA, 1847 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataa

SEQ ID NO: 378615 - DNA, 3181 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378616 - DNA, 2062 bp, Homo sapiens
agtgtctgggggccgcgcccagctgggtcgggacgcgctccctgagctgcccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378617 - DNA, 2191 bp, Homo sapiens
cggcacgaggggcgcaggccgtctaagggattgatggatgtggcctgccagggctttgcctaccacacagctcagagcacgggttccctgtcgctaacaaccgttgcgaagggaatcccatccacacatctcccagacagctggggccatatccgggctgcccgtggctgtccagtgaccgcccttcctcactgctccgggacacttctccctggggcagtgctgccagccttcaggaatgctgggggtgttgggggtggcctgcccagcctgacgctgactctccatgcagatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378618 - DNA, 4632 bp, Homo sapiens
  misc_feature (1477)..(1477): n is a, c, g, or t
  misc_feature (1488)..(1488): n is a, c, g, or t
  misc_feature (2461)..(2461): n is a, c, g, or t
aggcaagaattcggcacgaggaagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggaggacgcttgtgctatggagggaatgagattgtcactggaagctttggaggggatggtggagggcgccaagcggagggacaggaggaagaccaggagacccatccagccaagctggtgagacaacctctgatcctgaggaccggccgcccaccaagggttgggcccccggggccaggttgatctaccgacaccttccacttctttcctgggagagactgctggcttcattggtgattgatttggaggggggaaaaagggcagggtggctcaggctttaggcccaggtactggggaggcctgaggagccctcctggagctcaggaggccgaggctgccttnagctgtgatcntgccactgcattccagcctgggagagagagaggacctgtctgttgaaaaaaacacaaaaacaaatgaatgcatgtggccagtgccaggtgagctgccctgggggttcactggagttgaggcaggggacagtagtctcccctgccagcctaggattttgggcgtcattcacccactacccctagtgctagtcccagaggatgctgcggagggggcagcctcagctctcttttcagagaagatcaaagctgggcttcccagggtgcctggctggtccctgccggcagctttgtgctctccggctctttgtgaaaggaatcttggcgcagatgtttgtgttgcctcctcaggcacctgtagatataatttacaccatgatatcattgtctcaccttttgcctgggtggctgcctgagaaaggtctttctttttatagaaaagatcaaggctgtctggcgcgggactccatgagccccaggcgctggtcagaaacggggtagtctctttggcgccacctagtgtccagtttggcccatggcggggcccattcacggggcaacactgggcttctgggcacagcgggaatacagaaagatacagcactcctcatgccttcctggaggtagaaggccagtggcagcgactgagctggcatgaatgaataagaggatgtggcactgagcgccaagggctaccttggaacgcaccgaggagcgtcccgtgagttcaaagcagtggccgtgatgcaaaaggagggctgggtcttggagacgtggagaagaggaatgctgagtgatggggtggctgctggggggatgcttagctcagagcagtggctgatggggacactgagataagatcggaggggagctgtcaatgccagaagtggtttgaacttccccttgaggctctagggacattttgttttgagacatggtcttgctctattgcccaggctggagtgcagtggtacantcttagctcactgcagcctccacctcccaggctcaagagatcctcccacagcctcccaggtagctgggactacaggcgtgcaccaccacacccagctaatttttaagtttttttttttttttaagagatggggtctcactatgttgcccaggctggtctcgaacttcgggccccaagccatcctcccaccttggctttccaaagtgttgggattacaagcgtgagctaaccttgcccagcctctgggaacacttggaaggttttaagcagagaagtgacaggttggaaaagatggtttggattattgatatggacagattcccacctgtatgtagcacgccatgctgggccagcagtgtcataggagtggagggggataagtggggactggggacatgtgaaatgatgggcattccagtgaggcatcgaatgccttctgagggctttgtaggttccagctcaaatccccctctggctcttgttctttggtgtggcagccatctctcctcccaggggtcctgagggtttcagcaccagggttctctgcagccacacaatcagcccggctcgggagcaaactcccctggaagaacggagttatgagttggtcagcagaggaggctggggacaggcagtttttggtcttttacctctgatcttgtccccaacctaagccagctagctgcgtgctcccactccctctgccgcacgccgcccgtctatgttcccggactttgtccagtgcagtgccctcttcccttcctgcactgaggagattaactgaagtgacagattagagttagaagtggcccaaaggagcatctggtacaaccccctttggttagagaagggaaagtgacttttccaaagctgcacagctagacagtcataatggctaagctctgggggtgcttttgatgtgctagggatacttccaatgctttaactcacttaatcctcacaacccgagataggtactgttaccatcctctctgcagacgaggaaaccgaggaccaggaggttcagtaaatggtccaagtactcctagctagtaaggaatggatctacagcctgcctcccaggtttctggcttgtggggggcagagtttgtccctctgtcatcagaggcagccttccaggcacagctctggtcacctctggtcacaactggaggtcaccacagccctccccagcgctctgtaggctctcagctttgtgcttcctcccacgggtactagctccagctgagcttgcaggaaacccacttcctgaagccaggacttccccatgggaagtgcaggggccactgggcagcctgagggctgaccctgctcaggacactgtctgtctcaggaactcatggcagtggtttaccttgtcaggagtgcatggacgggctgcccctcccattccttcaagcatcactcagagagccctggcctggctctaggcttgggactgcggctgccacaggaagggggcatccccctactttgggtgttgggtcagatcctgcccccgtgcccgccagggctcaggttcctctgagctggtcctgggccaggacgcatctgcatggcggtggtggggaggaggggtgcgccatggcctggaggggagtgtgtgttggggtgtgtgtgtggaggttcttttgagtcacacacaaagcattgtgctgagacactgcattcctgctggctgggcttcctgtttccagatgcattcctgtcccagagtcaccacagagactgtttggaatcccgccccacattctccaaattcagggcgcgatctggcaaaggctccctcccccaccctcttactttggagggagtctgggctccctcctacccagggagggctggcagggctctggcacggccggggtgtgattccacacatcttcttggtcttgcataaggcagttcctggagacccagcactctggttctctctctgcctgtgagaagcggaatgggtactgtctaggaggactgggcagggtgggggcaacccagaggacccatggctagcagggaagggcctgggcttgaatgtgactctgttgagacatggccagcaattctggcacttggctgtcattcggctggcctgcgcagagattggctgtgggcctcagtttccccattttataaagttttaaaatctg

SEQ ID NO: 378619 - DNA, 3956 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtaggggacaggtatatgtggggcaggtggtgggctggggtggggggaggggaggtgggggatgcatgggcaccctgggggccagcaactctggggaaatgacaggattgattcctgtttggagcaggcgacttgtcctggctgtggcgacagctgtctctgggagcttggtcgggggtctgagtgtggggagggctctgggtgacccctcatcctctgctcagcgggatatctcccactgggacaaggtcaaggtcctgctcaaccggatctgccggagaagccaccaccaccctgagccccctgcccctcctgatggctctgaccccaggtgagccccgtgcccagcccaggttagggcacggagaggagactgataagccaggatgctgagattgtcatgccagttgtcattattgtccccgcaaaacttgagaggcagtctgggaggggctgctagaagaaacagtagttaaaacaccccatttacagataaggaggcagggttctgggtggggttgggggtagttgcttttccaaagccgcacggtgagtcagtgacagctaggaccagaatgtgggaaatctgcctaccctagctcagcaacccctcaccctcaatgctgacatttaggccaccttccaggttcgtggggagagcaaggtggagcacaaaggatttcacagtgggtgaaggccatcatgcttcggggcttgtattgaatcgttctccaggaggaagaaataccaagtcatttaacagccccgggctgcgcccacacccagctacccaccagcagataaaccacgttctctcaactctagggccattgttagttttatttcccccttctagcctaatgtcttcttttcattccacaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 378620 - DNA, 1630 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttggaacgtgttatccccccggtcgggctagtcgggggggtaccgag

SEQ ID NO: 378621 - DNA, 1689 bp, Homo sapiens
cagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtttgtctcgtggtggcaggttgggactgttggacggggggatacctactggcggctttctggggatggtggtatgggtggatgtttgcacttggtgaggttaggtacatggggggagggcggtgtggcgggatgatgtattatggaaaacgtgtggaaaaagattcatgggggctaaggg

SEQ ID NO: 378622 - DNA, 732 bp, Homo sapiens
ccgtgagggaagtggggagaagctgtcaccccaacttgagttcaagaagactccttggaaggagaagaccaccaaattgagaatgaaaagtaagctgtagctattcttgggatggggcagtggccccatgctctggtccctggcctcagcagctgtcccagctcataaccccaagtgccggctttcccatcccgtctcaggatctgcgactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtactaactctggcattgtagcgatatctccaagagaaaattgttttgaacttttctgggaaaagttcacatacgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccg

SEQ ID NO: 378623 - DNA, 969 bp, Homo sapiens
gggtggctcggtgggtggccttacagttaatttaggatagttccactaggcagttcacttgcagacaaattagctaaacagccttctcctttaaatattttccatgtcacagtgaaactctttacaatacaataaaggtacagttttaattacacgcttcctgacttttgtttagttgtagttttaaaacatttgctggcactctttttttcctttggctgggcagtaatagctggttctaagtatctggctaatgaatttaataatttcctgaactgggacttaaaggacctctgcaaaaaaaaaagaaaaaagctgctttttctttagtgtcctgcaacttcaaatcccatccacaacgctgcccattaggctaggcactggcacttgaactaaccctgaacgaggctcacaagccctcttgcttctctgttccatgctccttaaaggtggtacttgttaggtctatgaggcctgcatttgaaaatcaattctggcaattcttcttggagaaaggcaacgtaatgtttgctcaagtgacatactccaataataaataaacaccgtgcgtctgttggcagattatttcagtgccttgttagcaacaggtacctaattgcttctcattttcctgagatgattcaattgcactaaaccaggagagacaaattagattcagtggatcaccagcatgttctccaactaagttaaaagctttcctaagaggcaaagaagtttgtggatgtgataggagaaagatgaacaaacctagcacttgggggcctaggccaggggagggggtgccacaattacagtagtagtgaaacgccaggggacgttctttctggagggaccttagtttggagagaaaaacttaaaatgccacaggaaatattctacaaataggggaccaaataattttgagctcatttctcttaaggtctatcaaggtagatcttaattaaaacc

SEQ ID NO: 378624 - DNA, 305 bp, Homo sapiens
ctttgttgatcccgggacacaatagagctccacattgactagcttcttctttcatgtattaattattttcttcatacagaccctcttccaccttctatgaaggtagtccataggtattttgtggagcttttttgtgtgtgtggttagaatgaagagaatgtttttcattctgtcttctaactggcaatatatagaagttcttaattcataggttgcaattttgtacttttatattaacaatgaatctttatgtataatagaaaatatgatgagaaatgaagaaaataaaagtcatttacaatcca

SEQ ID NO: 378625 - DNA, 901 bp, Homo sapiens
gtgtttaaaagcaaacaccctgcctttcttgaaaccacagaaactgcttgtgaaacagccgatagggcaggctgccaaatacagactgttaaaaccaatctcttaatgacaaaatgtcaaacactgatgttaaaccttcattatgactgtggtgtgaggatttttctcaataagaaatgtttaggtgctgaactcccagtttcacattcagaatgcttctattatcaaattcctcttggtacatcatttccgagaggcttgtgtagctaatccactatctactgtacaggaaagattttaaataaacctattcccattcatcctcatctgtgtttttttgttttttgttttaatttcaagaagtaattttcttttgaggtgatttggaccaaccgtctcactagcttttcccatttaagataggagaactagattcagaattgtgtctttttcctaacagaagactggggccttaatctttaccccccaggctctgattaactgacttttctttttttagatggcatagaatcttctgtctgtctagagaattttgtttcttgccaggcactgtcaggaattagtattcattcctccctgctatcttcctgaagagctgtgaacctgctggtagcctgatggataagggtacagttgtttgtttatttattgagacagggtctcattctctcacccaggctggagtgcagtggcatgatcttggctcactgcaacctccgcctctcaggctcaagctatcccccaaccttagcctcctgagtagctgggaccacagtcatgtgccacaacacccagcaaatgttttgcgttttttgtagagacagggtttccccatgttgcctttgctggtcttgaactcctgggctcaagtgatccgcct

SEQ ID NO: 378626 - DNA, 375 bp, Homo sapiens
agttagatttagttatgtttgattagttagattcagtctaatttaatttaattaacttccgctgtgaggtcctgtaacaccctacactttccctatcataggaggcaatacagtgatacttctgcaagttcagctcagcccttggaccatacaatcctggattcaaattgcacctctacctcctagtggagtttgtcaagttacttaacctaagttcccctttccttatagatgaagtgagattaataaaacagggttatagaagagcatgtatattaagtgcctatacagtgcctgagacatcgtaaacaataaataagtactagatgctgtcatcatcaccatcaccatcaccatcaccaccaccatcaccat

SEQ ID NO: 378627 - DNA, 152 bp, Homo sapiens
acacaaggccatttcatgtcctcaatctttgttgatatgctttgcttattttaatggcttgcatgcattttttattgtgctgttgataatagttttacataattcataatgatacacaataaaagtttcattgcgttcacattcctttgtgg

SEQ ID NO: 378628 - DNA, 227 bp, Homo sapiens
gatatttaaccctatatgtcaaattgtaaaactgtgttttgttgagctgttcgttctgctattccataccaaacccctatcaaaatactccataggaatctcgtgaattacagacacacacacacacaccatgtatgtagctattcaattctagaacttctaataatgacctgaactccttcagaacctattcctaaggacggcagatttcatcagccaccattttg

SEQ ID NO: 378629 - DNA, 600 bp, Homo sapiens
tttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctctta

SEQ ID NO: 378630 - DNA, 551 bp, Homo sapiens
ggggaaatggcaattaaggagactcagtccctatcctcacagaacaccccatctgacacggaaatagctcctggcccgcaatgtggtaagatgcagtaatacgtgcaaggcccctgacttagtggcaatgatgtttaagccgagatctgaaggataactaacaacggcgtgccagagaaaagagtagcgggtggagagaggaggccaggggaatatttctgggcttggtaagtaagccaggtccctgccagacatggactgagaagagcaaagccaggagtgacagctgatgattattttttaactgaggaaggaagatccttgagaacggaacctcttgggaccttctacccagaacaccagagcacctcactgggatcagagccaggccatcgggtggattaagcaactaaaattgattgtcctgaaccatgagtctgtctgtttatggggagagaaactttgagatgaattaatccacaggtccaatgggactttgacattttaatttgtagaaataaaacttgcctttgattttgcaaaaaaaaaaa

SEQ ID NO: 378631 - DNA, 479 bp, Homo sapiens
cgaacctacttgagtcttgggggcattttcacgggttccctaaagggctctggaggactcctccagccatgactcatggatgcatctgcttcctattgccactcctcagcctccagtggtctcagtcttaccgcagacactccctgctggagcccctccacgttcaggtgaccagtgcccataggcacaacttccaatggcctggagcccactctctctagcaaggtgcttgcacacctggacatggagaacacccctaaaatgcagccacctctactgtccatgcaggctctgtgtctcacagctgcagggaacactgtcacctggaggtcccactcaccaggcctcagtgaagacggtcacatgctctgcatcctcccacttcatggcctaccccagctctccccacagatatctctgcacaaaccctccttgcctctctacacatcctctccctctgtggtccctagaagaacagg

SEQ ID NO: 378632 - DNA, 289 bp, Homo sapiens
ctgagctccagactagaaagtcactgttgaccattccctcctttctgaaaatactgccgtctattggctgccctaattccagaatcaggttttcctcctacttttttttaccaaatgtgtctcagtcttctgaaatctgtcactctcctgcttagagcccttctgttgttggaattcagtatgaattataaatccagggggtacctggctcccaccgtggtgcttccctccttgcactagctccagctatcctcatctgactcttctttcatttctacagacttcgctc

SEQ ID NO: 378633 - DNA, 518 bp, Homo sapiens
aaccaggaattgtgggaggttttcaatgtttaagaaactgtttaagaagttttctttatgatcaaaatatgtttattctctcaatttctgaaccaataattggcttgtcattttaaagccttaacaaagttattgtggcaaaatattttcttgaaaaataatgcatctaattttcgacttcctgtggccctactactatccttgcttcccaaaacaaaggtctccaactcaggcaaatacagtctctgcaaagtggaactcaaaatattaacgagtcactgcaagaaagaatacagtgtaaaggaaatttggatgggactgcaagtaaaatcaatgaagtctatccaaatgtagatcctggaggaatacaatctgtgtctcttacatcaagaaagacttagtactctccaagaataccattttgtaccaagttcaaactggaggatcacaagtctttacatgtgacttaggaaacaggaagaagcaaccaaaccaatctaagtgaggcttcattaagg

SEQ ID NO: 378634 - DNA, 98 bp, Homo sapiens
tcttgatttttagttatttggctggtagcacagagacagaataaaatccaaatttcttgattcacaggctattactatttttactgccgctctgctgc

SEQ ID NO: 378635 - DNA, 4010 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378636 - DNA, 3479 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgctta

SEQ ID NO: 378637 - DNA, 4087 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378638 - DNA, 3855 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378639 - DNA, 3463 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcaaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378640 - DNA, 2594 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattgctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378641 - DNA, 3014 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtactgagacagtcctgactttattgatgagagctctcctcataaatttttaagtgacagttaagcagagttgactataggtatggggtccattgcactgtgtctggagtacctgcctgctgctcagcctgcccccgtcgatccatgagccagcactctcctgtcttccgtattccacagccta

SEQ ID NO: 378642 - DNA, 892 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgagtaagtgactgtgactactgtgactctcctgacagcctcagcctcctcaagtattcccctccaggttgtacttgtccttgttagcacagcctcatgag

SEQ ID NO: 378643 - DNA, 429 bp, Homo sapiens
ggatctcaccatgttgtccaggctggtcttcaactcttggcctcaagtgatcctcctacctggaactcccaaagtgctgggattataggtgtgagccacagtgccaagcctgttagttggtttttacacatcttggttttaacctctaactttcttatttttatctctcttactatcttttcctttgtctttttgttttattttactttctgggaagctgcctcagctttatttttcaaactttctatttaattttttatatcttctatccttttttcttaatttctaagttatctgttctataattgacccttttatgtgtcttgtttaacagatggaatattttctcatatttctctcagaatattaattagtttctttgacgttttcctctctttccagctaatatgcaagtgaaccagtgacctg

SEQ ID NO: 378644 - DNA, 246 bp, Homo sapiens
tgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatggtgagtagaggtgaattttttaagacctggcatgcctcgaaatgtccataattccacctacacacttgattagcagtc

SEQ ID NO: 378645 - DNA, 200 bp, Homo sapiens
tttgtttgtttcggatctttgcttttagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgt

SEQ ID NO: 378646 - DNA, 4044 bp, Homo sapiens
aactgcgggcggcgcagggcaggggcagtcagggagcagcggcggcagagacagggccgggcgggcgccgcctgcggagagcaccgggaggcgggccctgcgtggggccgcgcgcagcagcggcgacgactttatctgggccgcgggggacagcgcagggccatggaggaggcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaagactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378647 - DNA, 4094 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagtttagtactgctaaactaaagtagattaatgagaagggagagagagccaagaccatcaagcagacaaagaatttctctcttcatatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacatgcacatctggtgtttatgaagcagatactggggcttcataaacacagaaggggcagggaagtagccccagggcatagtgtggggcctcctgactaaaagtagcttgcaaacccctgcctataacagccacttcctggcagtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcggaaacaccaggggttccatctaggtcttgctgctcatctcacagaaagccagtcactgagacaagtattgtcagggaagaaggctttatccaggtgctacagacagggtgaacaagagatcagtctcaaatccatcatcatcaactgactaaaattaggggtttatatagcagggaagaaatgtaactacatgtgggaaaacagggattaacgaggggcaaggaagaggagttggccaacaggcagcaggtggtcacctggggaatcatgatgggtgaggggtctggcttctcactttccagatgtggggatctggtaaatttcagtttcttgataccgtctgggaggattgctggctggtttcctgagaaaggaattcagatgacataaatgtaaatttctccttgggtttcaagactgagagggtcaatttctaggtttattcaagaaaaaccataaacatcagttctatgggacaattgggcccatttcaaggctctgaggataagggttaatgaggggacagagtcgcctggagaagttcactggggcctacaagaaactagagaggcttcctggcaaagctctatgctgtctatcctctcttctctccttgcaggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378648 - DNA, 2746 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgaagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggaagattccagtataatagacccgaggtgaaaaggcttttgttcaataagtagaaaactgaaggggggtgggaggcacatggatttgaaccagagaccgcttggcctgcaggcaaatgctgtaccttcagttgcacccctcacttgttacagctgtttctgataagcacttgtgcagccccatcagcacctcgatttcttcttggtgagtccatgggaacagccccactgcaaacaacccattcctgctctcctctttcctctaaacctcaacctcctcctacctggcagtccacaggcctacagcttctcctcagtgggaaagacatcagcttggaaaaccacttggaaagccaacgttatcctagaaaagctttttaaatgacccagcaggacaagtctccggatggccttggccaacccggtgcttccctcttttcttggttgtagttctcagaataactagagaatgtactgggagtgttgtcctgagataaggaggaactgtcctaaacctggactctgttcccatcacacctagaacaggatgtcctgcaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378649 - DNA, 737 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaaggtgcctatgacatttgatgatgtggctgtgtagttctctgagcaagtgtggggcaagctggaggactggcagaaggagctctgcaagcacgtgatgaggggcaactgcgagatgctggtctctttggactacgccatctccaagtccgaggtcctctcccagattgaacaagggaaggagccctgcaactggcgccgccctgaccccaagattccagatgttcctgtggaccccagtccaggtaagggctgggagaaggccagggaggcatcaggtattttgtgggaaacagagatggaaaggccaggaagggtgtgatctttccagagagagtcgaggagaaacatgaaacttacaggttttatgtcttgaattttttatagttgagttttaatctctaacttagtcagctaatg

SEQ ID NO: 378650 - DNA, 952 bp, Homo sapiens
aagcttgcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgaacgctttagcccaatgatccaagttgcccttggggtataaaacttgacagcagagggcgttcagggtccctcagctgcagtgtgaagtgggacacacaggtgagactccatctgccctgggcaggttcctgagccttgggggaccagttcaccctacatcccaggcttctgttgtcccttgcctgcctgtaaggaataaagttgctttgcttaacttgctgtgtgagtgttctgcatcactggactcgagcaagtggtacaaactgcagattaataactggtacgtggtgaatctgcttcctaagtgtttgctgaattttgcggcccaggagatcatctggtgtttctgtgatgtgggaagattaaaagaaagaaaaatcaaacctcacacctaacaaatcagaatctcaaggtgggacccaaggcatctgtatacttgaccaccctcccaggtcattctggttctcagacatgtttggcaactttgattttagtctatacttgcatgttatatgcctgaaagaaaaaacaaagactaaaggcctgcatgagttcacacatcaccttaataacaagatcatagctagaaccacattcctagttttgggactttccattgccgcagcccaaaggatgactagattcctttccatctcttctccctccacttccttcccaggaacctcccctcaacctgccataggacctggggcaacctaaaggtaccaattggtatgtggtact

SEQ ID NO: 378651 - DNA, 431 bp, Homo sapiens
cttgttcttggccagagccatgatagagagtatgtgtaaaaggcaaacactctgacacatacagacacacacacatcaagcagtttcccgtaaactctaccaggagttgctatgcttcagtgttgggttagaagaaggaaaagataaattgtactttaacctttgtaactgagctaaagaaaaaataagagagaaaacacaccatgtgctggccctggatcaggagacctggattctagtactggtatcctgaaattttgttgtgtccttgatcaggtgggtccccaactgtgggcccaagacccctgtctataaaataaaggggtaggtcatagctctgaaattctgttcagattatcctttagctctcacctgcactcagtgcatctaattaagtaaagacggaggcagcaggttacatgtcatgttgt

SEQ ID NO: 378652 - DNA, 388 bp, Homo sapiens
cctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctggg

SEQ ID NO: 378653 - DNA, 1117 bp, Homo sapiens
  misc_feature (5)..(5): n is a, c, g, or t
  misc_feature (8)..(8): n is a, c, g, or t
  misc_feature (10)..(10): n is a, c, g, or t
  misc_feature (392)..(392): n is a, c, g, or t
  misc_feature (402)..(402): n is a, c, g, or t
caganggncnggcggcggcggcagcggccacggccaccaccgcggacgctattgttccctggtgttagacgcgctctccctccttctcatctgaagcgaacaatagcaggaaagagctttgctttctgtactctttgaaaagaagttccaagagcggagaaaaattccctgccgagcgtgctacggctctggaccctggagtggctgcaggcggcatggggctgcaagcaggcgctgggcgtccgggagccggggcgctgcggggccgcgccggggcgtcctgctgccgctgccgctgccgctgccgctgccgctgctcctgctgctgctgctacgcccgggcgccggcagggctgcggcgcagggcgaggcggaggcgcccaccctctatntgtggaagantggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaag

SEQ ID NO: 378654 - DNA, 930 bp, Homo sapiens
gacagagtgcagccttttcctcccctaatagaaaagccattgccctcttttcctcccctaatagaaaagccattgccctcttttcctccacccttaagaagacctgcatctgttggaccaacagacaactatccggcttacggccaggggagcccctgcagctgcacagaaccagtttcttatgtatctggcggtaattgggaaagcttctgagaaagtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaag

SEQ ID NO: 378655 - DNA, 788 bp, Homo sapiens
  misc_feature (788)..(788): n is a, c, g, or t
gacagagtgcagccttttcctcccctaatagaaaagccattgccctcttttcctcccctaatagaaaagccattgccctcttttcctccacccttaagaagacctgcatctgttggaccaacagacaactatccggcttacggccaggggagcccctgcagctgcacagaaccagtttcttatgtatctggcggtaattgggaaagcttctgagaaagtccatggggccgatgtatgggagatgaatgtggtcccggaggcatccaaacgagggctgtgtggtgtgctcatgtggagggatggactacactgcatactaactgtaagcaggccgagagacccaataaccagcagcagcagggggacctatcaggacagagttcacatccatgtgaaaggccagccaccagttcaggagcacttgggagtgatctaggtgatgctatgagtgaagaagacatgcttcaggcaggctgtgcccatgtctttacgatctgtcagaaatgatttgaaagcagaaggaaaaaaataatacctttaaaaaataatttagatattcatactttccgacattatcctgtgtgattacagcatagggtccactttggtaatgtgtcaaagagatgaggaaataagacttttagcggtttgcaaacaaaatgatgggaaagtggaacaatgcgtcggttgtaggagtaaataatgatcttccaaatactagccaaagaggcattcagcaattaaaaacgaatagaatagttttgtaaaagaaaaaaaagaaaaagatn

SEQ ID NO: 378656 - DNA, 447 bp, Homo sapiens
cccaggagctgtgtgtgtctgtgtgtctgtctacctggcaaggagatatggcccccatcagactggagctccacagagcaggtcaagcgattctcctgcctcggcctcccaaggaactggaaccacaggcgcgcgccactgcgcccaaggattttcacttttaactgtacagtgaagcacagacttctgagccagactgcttggtctgaactctggtgtcaccacttagtaagttctggtttgaatgtactcactgagtggtcttcataaattacctctctgcacttgagtctcctgtctgtaaaatggggataataatcattacaacgaagcctcataggattctggtggagaccaaatgcattaatacatatgcaaagcatttggaacagctggcatatataagtgccatatatctattattaaaaatttttaaattataagaat

SEQ ID NO: 378657 - DNA, 523 bp, Homo sapiens
cccaggagctgtgtgtgtctgtgtgtctgtctacctggcaaggagatatggcccccatcagactggagctccacagagcagattggagtctggatctgtcacgcaggctggagtgcagtcgcgcgaatctcagctcactgcaacctatgcctcccaggtcaagcgattctcctgcctcggcctcccaaggaactggaaccacaggcgcgcgccactgcgcccaaggattttcacttttaactgtacagtgaagcacagacttctgagccagactgcttggtctgaactctggtgtcaccacttagtaagttctggtttgaatgtactcactgagtggtcttcataaattacctctctgcacttgagtctcctgtctgtaaaatggggataataatcattacaacgaagcctcataggattctggtggagaccaaatgcattaatacatatgcaaagcatttggaacagctggcatatataagtgccatatatctattattaaaaatttttaaattataagaat

SEQ ID NO: 378658 - DNA, 459 bp, Homo sapiens
tttgcagttttcatcagttgctggaaacttcattcctgcttgagtgtgtttggctaggagtgagaagtattaatacattttcttttaaaaggctgtgagagagagagagagaaagagagacagaaagagagagagagaaaaaaaccccccccccacccccccaacaaaacaaaaacccccccaagagatttggaagccgggcaattgactctgtgcagaggtaaaaccaaatatgatcatagatacgacagagaaagagacataaagatttcatggagctatccttgaaatgaaaggaaactaaagtttattgaacatctcccaggaactatccatctatgatctcatataattctcatggtaattccaaagttaggagtaattatctccatttcacagatattaagtctcaaggtcacacaaggtagaaattgagagagctgagattcaaacgcaggc

SEQ ID NO: 378659 - DNA, 588 bp, Homo sapiens
ataaaaatcattctcctttaaatattaagggggaaaagttttccattttctttggtatggtttttattatatcttgagggcaaagacttccaatttcaaaatggaaatcaatgagaaacatgattgaatttaggaaacatggttttacagccaacagttttgggctgtgccagaagttctgaaggctataactatatctataattcatactaatattttgaggatttgaaaagcagctgggtcttagtttcctgagaagctaacttcaagttggtaatgtcctatgttctttgggagccagagataccttgagatgagcttatttccttgcatttttcttcatgctcctcccacctctgtgggccatggaaacggttagatgggctaatgtgcctaaggaaataggccagaataagcaatacatggcagctcttgtgatcattctactcctggaaggagctccaaggggccaggaaattttcagggacttatcaggagatgaacgatggagatctgaggacacagaagcagttctattaaaaataatgccaaaaactacaattacttttgcacccgcctaataatagt

SEQ ID NO: 378660 - DNA, 556 bp, Homo sapiens
aaaggtagatcgtttgctgaattactgatcaattgaacttgatattataaaatggaagcttattaagcattgagatacttgaatattaacatggatgatttatgtctacatttttaaaaattatgagaacgtcctgttcagttgagtgactgcatttaagcaatccttccccttccttcagaatccccacctaatagccatgaagctgtagaaatggaaataaatccaaaatagcaccatcagaataagtgccatcagcaaaccagaaatttagttgtgttctggaaagccgaaagtaataaaaccctactgaaaaatacccctgaacagggaaggtcgtgacacagcaaaggaagaatcagacaggaacaagttttagtggtggtgggaacagcccccaggagccccaggaaagaccacatttccactggaccccaagagagaacaagtgcgaattgcttgcagtgatgggaacacctggccatccttcaaccattacccctccacccccatcctcacggattcccacacagagctttcaggatgattttttctc

SEQ ID NO: 378661 - DNA, 770 bp, Homo sapiens
atggagaaaacgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattttgggcatcctcatgaccattctgctcatcgtcatcccagtattaatcttccaagcccatcgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatatgaaaaaaaaaaaatggcctcgttggctacagcgtggagtgtgcgcccaacttttttttcttctatctcttatattctcctctttaattct

SEQ ID NO: 378662 - DNA, 682 bp, Homo sapiens
atggagaaaacgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattttgggcatcctcatgaccattctgctcatcgtcatcccagtattaatcttccaagcccatcgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatatga

SEQ ID NO: 378663 - DNA, 621 bp, Homo sapiens
gtcggtcctcataggttcgcaggagcatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattttgggcatcctcatgaccattctgctcatcgtcatcccagtattaatcttccaagcccatcgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatatga

SEQ ID NO: 378664 - DNA, 745 bp, Homo sapiens
acatggctggctattaaggaggctcaggtggagggatctcttcagcccaggaatttaaggcttcagtgagctaagattgggccattgcactccagccagggcaacagaccaagacccagtctcaaaataaataaataaaaatgaaagaaagcagtgcactgaaaatcaatttaagtatttactggagttgtcttgaaggcccaatgggaaatgtcagtaagggcacatgagaaaacactttaagaacctattcttccaaagatctttccagtatcttatgacaacacagtaaattatacccactccaactgcaaaagctgaaactactctgctttctcacttacctacacttttgactttccaaatacatttctctcttcggatatgagctgcaaactccttatataaaggctccaactctgcagccctaattattctagttggcccaagaaaaatcctaattgttttatctaaggagacggaattttccaatactgtagaggcatgtgtgtgtgtttgctttaaggaagctgttttggtaataaaaagtcactgaaggtcataaattcatgttaacacatccagtgtacatgaagtaggcaccgagttaaactatttgtctactatatagcatgtcatcttaaaagccttattttttcctcaaaatattaactttatttttctccctgtaaaatcaagacacagttaaaatgtagccttcctcattttctgggaatactttcta

SEQ ID NO: 378665 - DNA, 135 bp, Homo sapiens
gcatagaccaaaaggttggcaattattatatatgcataggagaatgattattgatttttattttcctatgaatgttatttgatttcttgttaaaatgaagttatattatttgaataacaaaacttttttaaaaaa

SEQ ID NO: 378666 - DNA, 323 bp, Homo sapiens
gtaatgtagtccacggggattggcaaagaaagaagtagaatacgtgaagacaggggagggccaatgaataacagcaaataaacagtacagaagctgcagtggggctgagattacagtcagcatagccattcggatatgttatttacagacaagaatatgtgtttgtcaagtattgttggtataaaataagcttgttgtattcttctgcctctgaaattgaaccacggagaagactaagaaatatgcacaatagattacaaagccaaaaaaataaacaatcatgagctaagtcatgtactgagaaaaaaaaagtggaggctcag

SEQ ID NO: 378667 - DNA, 576 bp, Homo sapiens
ctagccaggctttgtagcatgtgcctgttgccccttctaattggaaggctgaggtgggaagatcacttgagcttgggaggttaaggctgcagtgagcagtggttgcaccacctcactccaacctggggtcagaaggagaccctatctcaaaaaaaacaactttgtaaactgtgatccacacctcagtgcagtgggataaaactgtccagtagccttggcctccgaggccctgtctgaatcctccttttttgcacctgtagctaaagggcagcaagtgttttctgtactctatattcacttttagacaagtcacttttagagacttgtttaaagattcaaaatgagttataataaaaaataaatgtaaaatatacctagcaattggtatcgattgacaagaaagctttctttgcttgttcccacatgaagaaaaaaggtgaagaattacaaaaggttggttcagcttttcaatttttttgtgttaagtgggtgtagctaggataattaatgtcccagggaacttttgtaaataaggaagaacattcctgtttattctttcattaatgctagttttga

SEQ ID NO: 378668 - DNA, 435 bp, Homo sapiens
ccctgcagtatgatctgaatgtggcccccaaagttcatgtgttggaaacctaatccctaatccaacagtgctgagagggtgagatcttaagaagtgattacatcatgagggatctgccctcgtgaacggaataatgtcactatctagggagtgggtttgttataaatgcaagcttagacaggcgtggaggcatgtgactgactgtagtcccagctactcaggagtctgaggcacaaggatccctttagcccaggctttagagaacacagtaagtcatgatcacaccactacattccagcctgggtaacaaagccagatcccatctctttaaaaactaaacttaaaaaagaaaaacaaacaacaaaaaccgagcttagcactttcttgtgctctcttgccaagttataatgcagcaagaaagctctcgccagatgc

SEQ ID NO: 378669 - DNA, 393 bp, Homo sapiens
tccaacatactgggaaagagaggacgctgtcatcaggtgttaggtgttagggaccccaggggactagcaatttggtttaatccaggaagtgggaaattgctagaatctttgaattcaggtttgagaagcagggcttgaaaccttttctaactcttcattcatccctttcctctaaaaatcttattgtatgcgccagctgggccacaaaatggaaatcttttttaaaataaactttttattttaggataattttagatttgtggaaaatttgcaaatatactacagagatgggttcttttcttttgagacagagtctcactctgttgcccaggctgaagtgcagtggtgcaatctcggcttactgccaccttcacctcctgggttcaagcgaat

SEQ ID NO: 378670 - DNA, 251 bp, Homo sapiens
acttgacaaaatacaacatcctccatgataaaaacacttaagaaactagaaataggaggaactccctcaatctgataaaagagtacctatgaaaaactcacaccaaacattatgtttaggagtaaagactgaaaacgttcatttcatctaagatcaagaatgagacagggtatctttcttgccacttctattcagcattgtactggaagttctagccagagcaattagtcaagaaaaagaaagaaaattca

SEQ ID NO: 378671 - DNA, 239 bp, Homo sapiens
gaatgagatctttgcccagcagagatgacaggtactaactctaccaatcagattctccttattgcaagtttgaaatggagacacacaaagtcatgaaccagcagggagcctgagggagcaaaacccttgagtaaccaagaagcctctcgaatgaacaggagaccagttgagtggtacttacctccctccaaccacatttcatctggttcatcttttttatttatttttgcttttccaga

SEQ ID NO: 378672 - DNA, 1123 bp, Homo sapiens
gcttctggaagttgccaggtactgttgacatttaagcatgtgcaattttggggcccatttttatgtttttggatccagatggttgttccaaaaggagcactgtccctgctgatcaagtgggaagcaaagaaacaagtttccttctgcgctgaaatccccggcgtggggcggctctgctgccgtcgccatggggctacagcatctcaccgcccaagagcggtgtgcctgtgtctaatgaacgtgttacatggcctgtgtggtcacttttctttgagaaccttgtcatgtgccctagcagatggcaggtttgcatttgggcatgaaaccgagcacagtgctggcacgatcactctatttcttgagacttacttaggtaataagaatttataattgaattaagttggctcttataattaattgctttgattctgatgatgtggacacatgattgcaagctaaataccaaatatcattatgtatcttttctgatatcgaaagaagggtagtttaaataaaaaaaattgtagcccccttgaataatgctttccgtttgcctaaaggtggaaactcataggtattcactaaataaagaaagaaaaagattacaaaagtagtgaccaagataaaaccagaggcttagggctctgagagttcagcctgggccgtgatgttcaggagcagctgtctacctgcagagtcctgggcaaaccacttaccctccacgggactgttttgtcctggttacaacgggaggagttgactgggtgaccccagggtctctttagctctaaaaattctcagattgtgtgactgtggtactctgaagggcaggttttggtaatagcatcaggaccgagtgtgtgtgctcacacatgcacacagacacccccactcatgatccaaagcacagctggtggcctttatcggccttgacgagtgtccttttcaaatggagactttatcaaacagtgacatggcatgtgctgtgaaaatggtgactgttttgatgtcttccagttggctggctcccatctttccagagggagcactggacttctgggtaaaggaaatagcagtgaccaggaacaagagagccaccctccacacacatacttttttcctg

SEQ ID NO: 378673 - DNA, 165 bp, Homo sapiens
ggagctgttatttttttaagtgtaggaatcagccacccccaactgtatatttctgattgagtgagctagagtgcagcctagatatctgtatgtctttaacactgtcagatcattatgaagtgtaatgtgtttgaaaactgctacagctgagcagttgtggttttt

SEQ ID NO: 378674 - DNA, 2179 bp, Homo sapiens
tggggatgggggtcctagatacctaggatttgatataagctctctccaaatttttacatattgacaactaactcaaaaacttacaaacactgtgctaatcaaatgaaacatgcctgtgagctgcattcaatccatggggcattggtttgcaagctatgttcttagaggtggtatgattttgtattgaaattaaatataaccaagagtatgtcaatttttgaccttggaacctggaccttttacctcatttatattctgtatttttgtatgtggggctttttggccagtcaaaatagaaagtctacagcttccattttataatctaacaagcaacaagaaacaacatttgaaaaagaaacaggaatatagccattttttctagcaccaataaaaatggaaatgtttttcatttgctttaagtcattaatcagctgaaaaagaatagaaagagaatttcattccataaagaacttcacctaaaactctcagtgaagcaaaacaaaactccatgtaactcactcttagctttaaatctttaaaaagtgtttcgaagggatattgagtaaaaatgcagttatctattaaaaatacaaaatgctatattatatgatgctatgaattgatactggagctgataaaacattaaagtaattattccaaatcagtgctgactgcaaaagcaatatttccaaagctctagcttattttctgcggtcttttaattcccttgaaatagctttcttcaagttgagcagcaatttgggacaaacattattctattgcacagattatggcatcttactctggtttacacacacagagcaagggcttacacacctgaattaagaattaactagcatgtggggacagcaatagggatagtcctaccacagacgaaaccatgcgctctacacgtccctggataaaatgtgacaagttagcccttgaatttgggtccccatgtcaccaaatagctctatatttaagttgtgttaatgtggtacgtttcagtggcataatgacccattcttatcgaggcctttgttccatattttatttgtgccaatctttcttaggttatgagccctaatagtttatggcagcagacaagagactcatttctaacccattaaattcaaatggactttcttccactgtccatttcatttttggagctgttataaactaccgaaaacatttgacaggatcccattgtggatctgatacacttaaacagtaaaatgatatctaaacatctgaaagccaaagaataacctagtgcacgtgttcattcatttgtagaatttaagccattgtattatattttccacttggaaccatgcctttagatacaaaagtgtaaagtaaaaagcaacattatcatgggatgtgagacggtaatccaaaagttgaagaccaatttttgttatccatattttggaagtatggatactgtttattttaatatcacttctctcatgggtcacttttccttagataggtaggtaggtagatagatagatagatagatgatagatagatagatagatagatagatagatagatagatagataatataatatattttcttctttcttaacctatgagcagagactttgatgatggaaattactttgtaacattccccatggagcctaggaaaaacaatagaaaaaaagcatgaaatctttttctcatagtgaaatagagaagattctaagattggaaatctgtgtatgtggtgttctatcccaaataaagagaatttagggaattcaggcaacaatttttttcctaattggaaactttgttctgatcctgagatgcccacacaccccacaggagacgcagtgctggcccaccacagtgtttggaacacggtcagcattcaggaaacacattcaaaatcgtctaactgaattccactatccacttgtgaatgcaaacaaaattcaaatttccctgaaaatttattcaacttctatatgccaagcacactgctaaaggcttatcttctaagtatatgcaggcataccctactcacacaaatagcttattaccagagataggaaattgcaggtaatttgggagaaattgtcatagccaaatttatggaaaaaataaaataaaaacttctctatggcctcttgatttaagaaaaaaacagaacaatacaaa

SEQ ID NO: 378675 - DNA, 3465 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378676 - DNA, 462 bp, Homo sapiens
  misc_feature (15)..(15): n is a, c, g, or t
  misc_feature (44)..(44): n is a, c, g, or t
  misc_feature (47)..(47): n is a, c, g, or t
tcatcgtcatacccncgcgtatgtacgagggctgggtggcgcangangcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaagtaagagcgcttcccgcgccaccccctccccgaagcggttcgcgagaa

SEQ ID NO: 378677 - DNA, 4260 bp, Homo sapiens
  misc_feature (3887)..(3887): n is a, c, g, or t
  misc_feature (3895)..(3895): n is a, c, g, or t
  misc_feature (3897)..(3897): n is a, c, g, or t
  misc_feature (3899)..(3899): n is a, c, g, or t
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtggggctggnccaagccncnantcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtctcacagcacaggccagaaggctggatacctgaactgccaaaggagtgtgggcaggtgctacacagcaggtgcaacccagctcccaaaattgggcaggctgtgcacagaggccctgcaggcccagtggggatcct

SEQ ID NO: 378678 - DNA, 4358 bp, Homo sapiens
  misc_feature (15)..(15): n is a, c, g, or t
  misc_feature (44)..(44): n is a, c, g, or t
  misc_feature (47)..(47): n is a, c, g, or t
  misc_feature (3985)..(3985): n is a, c, g, or t
  misc_feature (3993)..(3993): n is a, c, g, or t
  misc_feature (3995)..(3995): n is a, c, g, or t
  misc_feature (3997)..(3997): n is a, c, g, or t
tcatcgtcatacccncgcgtatgtacgagggctgggtggcgcangangcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtggggctggnccaagccncnantcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtctcacagcacaggccagaaggctggatacctgaactgccaaaggagtgtgggcaggtgctacacagcaggtgcaacccagctcccaaaattgggcaggctgtgcacagaggccctgcaggcccagtggggatcct

SEQ ID NO: 378679 - DNA, 4380 bp, Homo sapiens
  misc_feature (4007)..(4007): n is a, c, g, or t
  misc_feature (4015)..(4015): n is a, c, g, or t
  misc_feature (4017)..(4017): n is a, c, g, or t
  misc_feature (4019)..(4019): n is a, c, g, or t
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaagttctgaactcccggtctccccagtccctggaggctgcctgcagctttgcttagcttctcagcctgttgatcactgccgtggaattggcgagtatcttccgggggaaagcagagacaaaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtggggctggnccaagccncnantcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtctcacagcacaggccagaaggctggatacctgaactgccaaaggagtgtgggcaggtgctacacagcaggtgcaacccagctcccaaaattgggcaggctgtgcacagaggccctgcaggcccagtggggatcct

SEQ ID NO: 378680 - DNA, 3977 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtgggggggtggcctgtacgccagggatcccttacgaatcatgtcgtactgcccttgtgtaagaggatgcttgccagacccatatatgagtcacgggacaa

SEQ ID NO: 378681 - DNA, 3406 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcacccaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378682 - DNA, 3486 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaggaccgtgtgtctcttcagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378683 - DNA, 3177 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378684 - DNA, 2678 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggatgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378685 - DNA, 2262 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctccatgggcttgca

SEQ ID NO: 378686 - DNA, 1974 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaaggtgatgggactggacacctagaggggactgtaactgaggctgcagaaagtatagccacagagctctggggtgaaccctggaagtgaccaggtgctgctgctagtactgctgcagacattgccacttggcatttgcaatgtttagttccccctcgaacctcgggcctggccctggcccggcagcaggcccaagcccctgtgtgcagtgtgagctggaaaggccctgcctccttgcatgttaacatctgaggtgagttacctcacctctgccccaccacctccaaagacaggcgtgggaccggctagccacaaccttatcaaaacacggtgcagcctggctgtgctctgctggctggaggcgttctctttcctctattcatgttcagaaaaaaac

SEQ ID NO: 378687 - DNA, 1817 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagaggctggagtgcaatggcatgatcttggttcactgcaacctccggctcctgggttcacgcgattctcctgcctcggcctcccaagtagctgagatgacaggcacccgccaccacgcctcgctaatttttgtatttttagtagagatggggtttcaccatgttggccaggctagtcttgaactcctgacctcagatggcccacccgcctcagcctcccaaagtgctgggattacagatgtgagcccactggccgatttcctagaacaagtaaagtagtccaaccacagcaggcttgacccagcctctgacaaagagcaaatgccctatctgtctcttcttgattcgcttttctttctcctcctcttcctttttcctgtatccatcaaagggtctctgtgatttctgtgttcaggaaacagcgaatatcttgtgagtgggtgggaatagcaactgggaagaggagagggagggataggagaagtgaccgatcatttctcaggggctgatgccctgtgccaggtaaaacctcagtacttagtgcactgtttgctgacgcggcatgagtagatgagac

SEQ ID NO: 378688 - DNA, 4478 bp, Homo sapiens
  misc_feature (15)..(15): n is a, c, g, or t
  misc_feature (44)..(44): n is a, c, g, or t
  misc_feature (47)..(47): n is a, c, g, or t
  misc_feature (4105)..(4105): n is a, c, g, or t
  misc_feature (4113)..(4113): n is a, c, g, or t
  misc_feature (4115)..(4115): n is a, c, g, or t
  misc_feature (4117)..(4117): n is a, c, g, or t
tcatcgtcatacccncgcgtatgtacgagggctgggtggcgcangangcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtggggctggnccaagccncnantcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtctcacagcacaggccagaaggctggatacctgaactgccaaaggagtgtgggcaggtgctacacagcaggtgcaacccagctcccaaaattgggcaggctgtgcacagaggccctgcaggcccagtggggatcct

SEQ ID NO: 378689 - DNA, 4209 bp, Homo sapiens
  misc_feature (3836)..(3836): n is a, c, g, or t
  misc_feature (3844)..(3844): n is a, c, g, or t
  misc_feature (3846)..(3846): n is a, c, g, or t
  misc_feature (3848)..(3848): n is a, c, g, or t
taacaggtccctttgtccttggcaggttctgaactcccggtctccccagtccctggaggctgcctgcagctttgcttagcttctcagcctgttgatcactgccgtggaattggcgagtatcttccgggggaaagcagagacaaaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatgaaacgtgtctgtgtttcctttgacccacagcacctgggccctgagcagcaggcttcctatgttcagtggccagaagcagagcttcaggtacattcgtggttttctccggtggacatgggtcctcagatcccctccagcccagtgtggccaccagggcacctccttcaatagactccaaaaggggcagctcctaccatctgggagaagcaatctaaggagatcacaaaaagtaacggaacaggagtcataatctttcttgaactcctgtggtttttactgaaacttgtcagaaggcataggagttgtgcgagggctggatgggaagtctagatttaaacagccaccaggcagcttatcaaagcaagagggcatccgttcacaggacaggggctcccagcaattcccagtggcagtggggctggnccaagccncnantcacccagacacaggggacttccccttgtgtcaacagcatgctagggcccagcaaactagagggtaggtaggaccaccttggcaccaactccactcaaaccacaattgaatgagggcgtcggcacgcattcagatctcacctcttgcctttgtttacatttattttgcaggaactggcactgactgacaggtaagaccaggaccagcccaggggtcccagaactgtctcacagcacaggccagaaggctggatacctgaactgccaaaggagtgtgggcaggtgctacacagcaggtgcaacccagctcccaaaattgggcaggctgtgcacagaggccctgcaggcccagtggggatcct

SEQ ID NO: 378690 - DNA, 3353 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378691 - DNA, 3191 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378692 - DNA, 3359 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378693 - DNA, 2425 bp, Homo sapiens
ctcccacaccccaacacacccacgacacacacacacacacacacacacacacacacacacatccatacatcaagcatagttgcagctcccagactgagtgcctggcctgggaacagggtggcagggaagggagggggcggggacagtggtcacccgctgaacgtgcatcagcgtctgtactcagcaggaccgtgtgtctcttcagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcctgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgggggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacaacccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaagatttatga

SEQ ID NO: 378694 - DNA, 2130 bp, Homo sapiens
ttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcgagattccggaaagcgtacaagccagagcaacccctggtgcgactgagaggcggtgcctacatcggggagggccgcgtggaggtgctcaaaaatggagagtgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaagtgagagctcctcccctccctccccaccgggctcccgaggggaccagagtcccaccagttattcctcaagagactctgaagccttgccatgagccaagcaatagaggaaggtagaatgaaatcctaagggagaaaaactgggggcaagagagatgaccgccaccccaaccacagatcgctgtctatgatgtagtggggagaaaagcgggagggag

SEQ ID NO: 378695 - DNA, 442 bp, Homo sapiens
gtctccaactcctgggctcaagtgatccttccacttcaacctcccaaagtgctaggattacaggcatcatgagccgctgtgcctggcctgttcttcttagatgatacaggctgaagtatttagagaagtgtcatgatgcctgtaacttacttgtagatatacttacatacatatgcatgtatttacatataaatacagcaaaatattaacaatttttgaacctagatagttcatcattgtgtcatcaatagtactattctggctgggcacagtggctcatacctgtaatcccagcactttgggaggccaaggcaggaggattgcttgagcccaggagttcaagatcagcctggacaacatagtgagaccctcatctctacaaaaaatattttaaaacttagccaggtgtgatggcacacacctgtagtcccagctactcagg

SEQ ID NO: 378696 - DNA, 687 bp, Homo sapiens
ttcctttgagtctaccttctattttccttcataatctagaggtaatatttgccatagcttcacatgtagactgattaggagggaactacagggagagttttattttaaacttatgacttttttttccatcacatcttgagatagtcacataaaaactttatgggacactattgataaattgtaagaacataatagccaaaagctttttctttttctttacttcttttttttctttctttgtgttcatggctgttcttaatatttatgctagtggcttgtaaaaattaagtttattttgattttttctgtatcttttttaatagaaaaaaaatgacagagtagttaaaatttacccctaaagctatggaaataaaaatgatctatcttccaagtcacctctataaatgttctttgaaattaaacggactgtcttgaaaacaagattgccagtttcctattcactcatagatgtaatatcaattgtgtctcctattattgcctttctaagtctttcgtttgtacaaaaaccatgtttaaaacatatcatcatccaatacagtgtctgtaagaaaaacaaacaatgattgatttggatagatatgaatgttaatatctttttctttgaatttctggcttgcatttttattaaaagtatgatattaaatatatatatgtgcacctgatgat

SEQ ID NO: 378697 - DNA, 1548 bp, Homo sapiens
agattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 378698 - DNA, 1931 bp, Homo sapiens
agattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaaaaaaaaaaaaaaaaaataaaaatgacaataacaaaaaacaccaaacaaacaaaaaaaaaaaacaaaaacagcagaaaaacacaaaacaaaaacaaaaaaacaaaaacaggggggccgcgcagcccaataaacaacatcacctagcgggaggcagaactatcttccgccgacagcagctcggtgagtagacagagcagcgcagccactacaagtcggcgtgtgtctaatcaaaccagccgcacaggcgagcggtcgaggaaaacatcagacatcgaggagaagcagagagaccgcggctgcgagcgctgacgttaggcagacagacacgaccctcggtgggcgagcgccttagatgggggcggcaccatacctcccacggcact

SEQ ID NO: 378699 - DNA, 1338 bp, Homo sapiens
ggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 378700 - DNA, 1363 bp, Homo sapiens
ggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 378701 - DNA, 219 bp, Homo sapiens
ggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccact

SEQ ID NO: 378702 - DNA, 374 bp, Homo sapiens
attctgttccaccaccccacccccacacccctgcacccacatgtatgcgtgtctgtatgcctagcccaggtgtctctattcagaggctgtctgttgggggccttggctgaggcactttcctccactttgactccacgcctttctactcctagccctttcccgtttcccagcctgtgggctataaagaggcaggagccttttgtgtggggcaggggctcatttttcttgcctgttctgcatgtcatctgatcctcacctagagctgttccagggggataaggggaatgtgggggagctggagccgtcctcttttgcctcttgcccgcactgttgtagaagagaataaagacctgattgttactctcagtttggct

SEQ ID NO: 378703 - DNA, 413 bp, Homo sapiens
cggaatgaatgaatgaatgaatgaatgggggcctctcctacataacttagatcacttattgtgtggctgagggggtgtcaaaatgggatacggggaccgggtctccatttcaacctctgtggcctcagaagccctgaggcagtaagtccagtttctatttaaagagctggaaaaaaactggcttgagatggactcaaatacaagttgaagttcagtaccttcacacacctcctgttatcagggccggtgccatcattcactccccacttggagagatgggtctcaggagtttactcccttcagtgggcctcagaaaggcccgactggggacacagacgtgagagcagaagcagaggaggcaggaaagtgccggggttacagcgatgggctttgcagtgaggctgggggttggg

SEQ ID NO: 378704 - DNA, 760 bp, Homo sapiens
caggtatgtgccaccatgcccagctaattttattgtatttttagtagagatggggtttcgccatgttggccaggctggtcgtgaattcctggcctcaagtgatcaccctccttggcctcccaaactgctgggattacagacatgagccatggcgcccatcctgacagctgccgttttcttcactagtaatagcgtcattcctagcccttgattccacactcttctcttctcccaaccccaggtaaaagataatcccagagagactgtgtttttctttacaactttagggtagaaatgtttttttaaaaatcacagtgtgaactttattttctgatcctttaggtttactgtggattccctatcacttcatactttgatcagactaataataattggtgaagattttcagtaaactatcagaattctgctatagccatcaaacttcatgctttggtttgattgcccactaggcccagattctacatttcagtaacctgccacttttgcataaatttgcgtcatgggcttagtttagatgagtaactatttcgtggaggtacttgggggcagggaacctttttttctttcaacctgagcacctctagtttttatcttttttatatttcacctaagattcctttggaaacgggtttcacagcttttaaaaaataaaaagtttgaagctaggcgcagtggctcacacctgtaatcccagcactttgggaggccaagacaggcagatcacttgaggtcaggagtt

SEQ ID NO: 378705 - DNA, 310 bp, Homo sapiens
attcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaag

SEQ ID NO: 378706 - DNA, 289 bp, Homo sapiens
ggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcac

SEQ ID NO: 378707 - DNA, 253 bp, Homo sapiens
ctatttgattatttagacaaagagaatatggggagttgagggaagagaaggaagagcatcttcatgaagtcccagcagaagggtcagacccgcaaagaggccacaggatgggcaggacaacctcaagtgactcttttttccatttatggggggacaagctcttgctctgtcaccgaggctggagtgcaggggcacaattatagctcactgcagcctcaaactcctggaatcgagcgatcctcctgcctcagcc

SEQ ID NO: 378708 - DNA, 3467 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378709 - DNA, 3346 bp, Homo sapiens
gtgtaagtatggtgtacaatatattggtttagaattttttatgaaagtaacattttcttactatattacattgaaatagttatgaatctacggtataatataaggagatacttatagatctccatctcagcctatgaagctttggaaaggattgatggtttaatccgaaagtgtaagtaattggatgtgcagtgtggcctggggctgccttaggaacaggtgtgcctgctgcgtgcgtggctcctcctccaagccgaccctgcagttgctgtcgtcctccctaggtggggtgtgcacagatctggaaacacacacacgagtgcacacatcaacacttgactttttgcccagctctgccgtggccgaggttgcaggacaagcagtagacagggctgtgggctcctgttcccatccagaataatagggcgacagggaaccctgcagccagcttcagggaccactgcccaacctgacatgcagctggggtcttccctttgtggagatgaagttgtctgcatgctgcagaaagctatgtggctgtgacaccttctgcaccctggctgagggtccgctcagatggaaaaatgtcttcagggttttgaaggttccctgcctttctttttaaatatagctgccactgttcatccttttgtagcggtttagaaaacacctcatggtcattcccttgactcaattattgctggcattagcagtgtcactgtgaatgtttctttcaaaagcatgagtgctgagaggaaactgcttttcttaaaaacttaaaaaacctttagtcttcggactcccccgcccaggctaccagacattcgagcaaaacaaaggaagtatgtatcacggtgatctgggtgaagagagtagggagtagtcataaaacatttattgaagagcttacaactggaaatgcctattttagaatggtgttttaagtgcagacactggctgcccaagtgtcttgtgcctctggacgctaacttcctaggcgggagaaactggggtctccctggggaagggggcacatgaactctcgagggcgaaggccagagtgcacctgcttatgaccttcgaagtgtagagaggttggcaaagccgcagttattgaattaatggaagcaacttgtaactcaagatgcacgattttaaaaatgattcagtaaagactgacttgtaatcggggcgatgcttctctgctgtgtcaggctgggctgcggccttcttgactaccgggagcaggctcagcagatagaattgaagaccggagggatgagtgcttctccccacgtgctccccgacgactcacacatggacacctacgagcaggtagcctggtaccgtcagacgactgctgcggtgggaagcttttctccagtgtctgtcactgttcgattcggccctaattcctttcttctgtgttttctttggttcagggtgtgcttttctcctctctctgcctggatcgaaacctgccagacatgatgcagctatggagtgaaatatttaacaagtaactttatttgcaagagttgtccattcttggggtgtactagagatctttgtttgaagtactttaaaggagacagttttactcgtgtgtgttgttgttttccaagtctgacttttacttgtagttcatatggacttataaaatttctttggttgttaaagtactctgaaaacttaatcaactttccatgatactgaagggacgtgaggaatgggtctccaggaattttttcttctcctttttccatagcccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatgttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378710 - DNA, 3741 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatgtatacgttaaggcatcacgtcaagattggaggacttcatgtcagttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378711 - DNA, 2391 bp, Homo sapiens
aggtgatccttccacctcagcctcccaagtagctggaactagggtgcacaccaccatgcccagctaatttttgtgtagtagagatgggctttctctgtgttgcccaagctggtcttaaatgcctggcctcaagcagtcctcctgccttggcctcccaaagtgctgggattacaagcatgagccattgtgtctggcccatctttgttcttcattgtattctttaggaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378712 - DNA, 3426 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378713 - DNA, 1796 bp, Homo sapiens
  misc_feature (33)..(33): n is a, c, g, or t
  misc_feature (39)..(39): n is a, c, g, or t
aaactattcatcagtcgaccggtgttaatcagnagaggngctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378714 - DNA, 2665 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378715 - DNA, 2479 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcaggtgtgcttttctcctctctctgcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378716 - DNA, 2012 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacaggtcactgtgaacgctacgcttttcccagctggagatatccctgttcagtactgcgcccagcccaccaatggcatggtgtatttccgggccttctccagcctgaacacactccccgaggagctgaggccctatgtgcccctcttctgcagcgtcctcaccaagtacgagtcgcaacatacccttgtgtgtcttattaatgtctgctttgtgtgcatatctgtatt

SEQ ID NO: 378717 - DNA, 1858 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacaggtcactgtgaacgctacgcttttcccaggtctcgggttccttgggggaattaaatgtcactcctcacaga

SEQ ID NO: 378718 - DNA, 419 bp, Homo sapiens
ccaggctggagtgcagtgacgcgatctcggctcactgcaagctccacctcccgggttcacaccattctcctgcctcagcctccagagtagctgggactacaggaatttttaaaattttgtaaatctcagcagttctctgttttgatatttatcctgccataactcaaaagtttaaattttatttttaaaaaatgatgtaaaaatgacatggatgtacacagaaccagttacttgagaacactgctttaatgagcttttcagtggaggggctggagtttaaggcgcttcgttctgatctttaaatcaagcatattacgagggcatgatgaacgtgcccggattccagtgcatcatttctggttttgtcttctagatataatggctacacgagggaggcctactttagtgtcggcctccaa

SEQ ID NO: 378719 - DNA, 368 bp, Homo sapiens
gttcttcacgtacggtaattttccattagaacagcatctgaaacaaattcacgaggaagcactgagcaaattccagaaaattgaaccaagcaccgtggtgccagctcagacaccctgggacaagcctgtgagtgccccaccgtgtttgtgtccttcctggtaaatatgttgacatgaggacttggactgggtattgatgatgggatttcagatgctgtcatgtttggtacagagtatgggagagcttttcaagctgaaagaatggtaatttgtttgaaaggaaagttaacttagtggaaagcctgtttcgctccatttcgtgtatccagataacctagagtagttgacaaccgtcagacactgtgcct

SEQ ID NO: 378720 - DNA, 418 bp, Homo sapiens
tgcatcaaaccttttaattatggccctgaatattcctttttcttgtttcttttttaggtctagaattacggagtcaacaaagcaaacctcaagatgcctcttgtctgccagcgttgaaagtttccgatattgaacccaccatacctgtcacagagttggacgtggtcctgacaggtcactgtgaacgctacgcttttcccaggtctcgggttccttgggggaattaaatgtcactcctcacagaagcagtagagtcatgtcttggaggttttccctgaaacacttgagcagccctgtgcgttcatagtctcgctctacacgattcttctgccttgttcttaactctcggtggtgatagactccttcactcagtaagagcccgtgtgtgtgtgtgttcctgagaggggtttgatagggc

SEQ ID NO: 378721 - DNA, 3837 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggcattttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378722 - DNA, 3697 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatgttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378723 - DNA, 4034 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggtattttgagtataacagtgagaatctcaacccacagcctcacagatgacgttgctgttttccaagttcccggcatgcatgggcaggagcaccagcttctggtgcctccatccttgcttgtgatacgatttccacgtctgacaccctaaacacgcttcctgacatccgggcgagaagagtgcatcctgtcatttgttttactgacctgagacccagtggggccaacccatggcagtgtccgggctctttagggtggaaggaggacgtgggcacggcccgggcatggccacgttactctctggagccgcttttgctcacagcatcatcagcctcacgcggcgctgactgcatccctgctgcagaagcaggcgtgggtaggggtcagcgtggcacgtgggagctggaggtcggggtgtgatctctgggttgttagacacatccctgtggttgaaacatgcacgtgaaatgacagtgagatgcctgttgtcccctccgggacatgagtgcacagcccacaacgcgagctcccgggcagcggctccatcgtgcctgtggattgtcttctaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378724 - DNA, 4144 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggtattttgagtataacagtgagaatctcaacccacagcctcacagatgacgttgctgttttccaagttcccggcatgcatgggcaggagcaccagcttctggtgcctccatccttgcttgtgatacgatttccacgtctgacaccctaaacacgcttcctgacatccgggcgagaagagtgcatcctgtcatttgttttactgacctgagacccagtggggccaacccatggcagtgtccgggctctttagggtggaaggaggacgtgggcacggcccgggcatggccacgttactctctggagccgcttttgctcacagcatcatcagcctcacgcggcgctgactgcatccctgctgcagaagcaggcgtgggtaggggtcagcgtggcacgtgggagctggaggtcggggtgtgatctctgggttgttagacacatccctgtggttgaaacatgcacgtgaaatgacagtgagatgcctgttgtcccctccgggacatgagtgcacagcccacaacgcgagctcccgggcagcggctccatcgtgcctgtggattgtcttctaggaatggaccacttcttgtacggcctctcggatgagatgaagcaggcccacagagagcagctctttgctgtcagccacgacaagctcctggccgtgagcgataggtgagtggggagcgggggagacagcgtctgggactggaagccctcgtgctgactctaacagcgctcacgcagaagccagtcctcgctgaccacgcctgccttcctctcaggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378725 - DNA, 849 bp, Homo sapiens
ggccgcgtgttaatcggccgaggatacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgacttaa

SEQ ID NO: 378726 - DNA, 2426 bp, Homo sapiens
tgcgtcgggttaagaggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgtggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgatttaagtgatcccgacgaatttaagtgatcatgatcacttaaattcgtcggtgatcacttaaattcgtcggtatattttgaaggcaccaaagactcccctttagagcatcacctgtacgtagtcagttacgtaaatcctggagaggtgacaaggctgactgaccgtggctactcacattcttgctgcatcagtcaggtattaagtttgtttaaaaagggttttgtgtcatattaaaactctctgcttatgtaatactccttttgaatgatgtgaaattggcctgcaaaagcctaattctctaaggaaaagctttaaaaagcttaatttcaacattgtatatgtacataaatagtctcttataatactcttgctatatcattagtgcagatgtaacagcagatacctttt

SEQ ID NO: 378727 - DNA, 2698 bp, Homo sapiens
ctcccaggcttggtgcaggaaggagagcccttcagcgaggaagctacacttttcaccaaggaactggtgctgcagcgagagctcctgtgtctgttgtctgattcctgcttcatctgctgtttgatttttgtgggccttacttttcccatttgctcatgtatgtctatattcctatatctaatgtttcttaaaagacaaatctgactgtgtaggtgcatttgtttaaaaaatataactccccattgcctctgggataaagtcttatctcagtttacatatattcttgataacctctccaactttatgtctcaccacccccactcacttcgtaattcgtgccttatcagaatggacctgttatactggcagttcaccatatataccattacattttgtttctcccatctctcaggtagacttacactttcggcccagcacatcagtcatcgcccttgcttgctttcctattcactcctgttctggaaggtgcaccaccttttcttggaaggcttcccttgctctcccaggctagatgagatgtccttccatcagttcccacagcaccctgtgcatgtatctgttgtgcacttaccaatagtatacaagggatctatgacccaagtctctccccactagcttgtaagctcctcacagacaggaaccatgttttgtctttgtactccagtgcctagtatataagagatactcaataaataaatatttgtcaaatcaactaattgattccttgtgacctaattctagagaatgggaagaaggcctgttattttgttgtcctttatggttctttaggaaagctctccaagcttggcatttgtcagggtgggaggaaaactgttgaagtattaagactggacacatggctgctaattcatcagcttatcattgaaaaagtccatagccaaaacctgactgtgcacttactataggaccctgacctgcctgggtctccctgtctctccagccagtatatttaaaggtaatgagataatgatgagtgttttgaaaaatgtttagtgttcaaatagaaaccattcgtgtcccttcactctctgaacatagtctgcaaatctctccctctctggtatgtttctgttttgtggattagactgctaaataagcgaagagttaattttgaagttcaggtcaacaaattcctgtttggagacgggctgttcctgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgcctggaagtagctgagtctccagtcactggtggccttccccaagtgagctcagcagcatgtgctaataggtgccaatactgtgctggctccagtgggattcctctctgcaaagctgctggcttagcttgactgtttccctattcctctccttagaactttcatagccagtcaagcatagaattgcatccattcttctgaaataggtactgtgcctaatttttcattggcttggccaagattctgttacctgtaattatgtcatatgggctgactggtgtaggtttggtaggcctcactgctctccagaggctagtgttcctatcccaggatggctgttgggattaggagtggaatgaggaatagtttaggaccacaagagatttggcctccttggaacatgtaggaaggcctcaaggatgtaattctagcccagggaagaaaatccttttcagcagacgcttcccttcccttcccctagggaatgtgtccctactatagtaaactcttccttaagagagttttatgttttctctgtcagatcaatttgtttttcttaatgttgttcctatcaaaaaaaaaaaaaggaagaaatacagtcctcagacctgacagtttcatttttccccccaagtagaagcaatagaaaccttagcagttccaagactcctggcactcacttttcctctccatctttaggtctaacccagctcagcccagagtaaagacataaaagcctcacatgtgatttcctcttgcattttttctgctagaagggtccacagtacttactttatgcctcatctcaattgaagctggatgatgaggatagtgggcagtgattgcaattggggaatgcatgtactggatcacataaggtcatgaaagtccttgaaacagagccttgccaagcagaacccttgccactcatggtattcgatacagtctacccatctgacatgaaatgatattcttaatgagccattcctatggaagatagctattgccaggcacattcagtctcctggtctccctctcatagctatgtagggcctatgacctagaataaatggaaaaatgttatcaggaggaagagactgctggactcccctgagaggtagggtttgtgctaggagagctgggtgccatttatttcattttgatatatcaggtgctcctagtaacaattcctagtttctcttacctctgtaatcatcctgaatagtcactgcttcttgagctttggtgagtgttctctaaaaaaaaaaaa

SEQ ID NO: 378728 - DNA, 765 bp, Homo sapiens
aataagtttcagcgcataggccgtcatgtgcaattttggtgaagaattctctccaaggtcgtcttacatgaatgctaaatggtagagcaaggacaacggaggtgacatgaatagttctggcatctgagggcctagcctgttgccccagcagagaggggagcaaggacacctgtcctctgtggaggttctatgagagcccatgttccaggacagtcacaaacttgtttccaaccagaattcgcaagcagtgtcagtcctgagagagcaggaagcttgatcccctctttggtaggtgctggacttagtaagtcagcttcagcaggcccttgggattcccccggccagtaatcttttatcctgtacaagagccatctggatgtagcaaactgcagttcactcttttgcagggtaagggctcagctggctcagtgggacacaggctttagatgttcatgatcccctaatcgtgtcctcacgtacatgagctttctctctttccactcagatccagggtacatgactatgtgaatgtaagatatgcctctggtatgaaggagaccttggcacaaacgtgtggtccatcttgtggttctagacagtgtttcccaaacttcagtcattatcatgccaccattatatgattgtttccatgtccacaaattgtgcctgtcagcatttatttacttacttattttatttttttgaaatgtagtctcactccagcctgggcgacagagtggggtccgtctcaaaaaaaaaaaaaaa

SEQ ID NO: 378729 - DNA, 1071 bp, Homo sapiens
aataagtttcagcgcataggccgtcatgtgcaattttggtgaagaattctctccaaggtcgtcttacatgaatgctaaatggtagagcaaggacaacggaggtgacatgaatagttctggcatctgagggcctagcctgttgccccagcagagaggggagcaaggacacctgtcctctgtggaggttctatgagagcccatgttccaggacagtcacaaacttgtttccaaccagaattcgcaagcagtgtcagtcctgagagagcaggaagcttgatcccctctttggtaggtgctggacttagtaagtcagcttcagcaggcccttgggattcccccggccagtaatcttttatcctgtacaagagccatctggatgtagcaaactgcagttcactcttttgcagggtaagggctcagctggctcagtgggacacaggctttagatgttcatgatcccctaatcgtgtcctcacgtacatgagctttctctctttccactcagatccagggtacatgactatgtgaatgtaagatatgcctctggtatgaaggagaccttggcacaaacgtgtggtccatcttgtggttctagacagtgtttcccaaacttcagtcattatcatgccaccattatatgattgtttccatgtccacaaattgtgcctgtcagcatttatttacttacttattttatttttttgaaatgtagtctcaccctgggtgataagagacagactctgtctcaatttaaaaaaaaaaaaaaaaagcagcttaaaaaattactaaagaaggtcgggcacagtggctcatgcctgtaatcccagtactttgggagactgaggcgggtggatcacgaggtaggtcaggagttcaagaccagcctggccaagatggtgaaaccccatctctactaaaaatacaaaaattaaaaaaaaaaaaaaattagccaggcgtgatggcacatgcctgtaatcccagctactcaggaggttgaggcaggagaatcacttgagcccaggaggcagaggttgcagtgagccgagatcgtgccattgcactccaacctgg

SEQ ID NO: 378730 - DNA, 327 bp, Homo sapiens
gcaaacacaacctggaggccccgccctgagaggagggactgcatttcaacctcaggcatgctcacccagtgattcaaagtggaagaatgttctgtatttcaaactggtgggaggggtggtggcagcagtcacatggctgtatacatttattaaaactcatcaaattgtacacctgaaatctctgcatttcactatatgtaaagtctagctcaatttttaaggaatagcaaaatgtgatagcacatattcagtaagtgaagttaatggacaggaactactttatgatgaaacttcgacaaacatgttgatcaataaagatgcccctgc

SEQ ID NO: 378731 - DNA, 458 bp, Homo sapiens
cgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgca

SEQ ID NO: 378732 - DNA, 292 bp, Homo sapiens
aggtatcagttggtcagaattaggtgcacaggggccatttccttttttgcttcctcttgcttgtgggggatgaaatttctctcaacagtatttgattgctcaatatcacaatagtggaagtctttcgtgacccttgtggtgagtgatggggcagtggcgggagttttcccacctccagagtgacattcgagacccctccccggctgactcctgcaaccacggtcaccactgtttacaaagaccctgcccagccttcctgggtgcagggtcccattgttcctcctgcctgcag

SEQ ID NO: 378733 - DNA, 446 bp, Homo sapiens
gattctagaactcaagtctcctaaatccttgataacactgtgaggcaaaatttgcctagaattatttttaaaaatttatgcttgcacatttaaagacataggttaccctacagagtcttttttttttttcaccaaaggggcatgttcagtgtatttctccactttaaaattcctttatatatgcaaaataaatttagagagagatttaaaagcaattctaaggataaaacatttagaattctttgaaaaataaaataatcattccgtgagttttttttggtagttcaggcatgtaagtttaaagacttaggacaccatttaaaagacaaaaatttttctttaaccatcttcaagtttaagtctgtggaacggacaatattgcagtgagctgagatcatgccactgcactccagcctgggtgacagagcgacactccatcttaaact

SEQ ID NO: 378734 - DNA, 667 bp, Homo sapiens
taaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacttgtaattaatattactgttcaaaatttagggggaatctgtcatcttcctgaaacttcagaatcacctggagtaagggtcatttgtattcatggtcactgaccacgtggggtagaaactgcaagtcatggttccttcaggcaaagttaatagtggtgacatggaggcatcatgatagagcagcagactccagaagccaatttgactttgtgatttctgaaaaaattacctgtcaactgtgagcctgtttcatcatctgtaaagtttgaataatgatacctaccctgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggattccatagggctttattca

SEQ ID NO: 378735 - DNA, 1229 bp, Homo sapiens
gacatataggaactggccgatgccgatgcctcttttgcagtgtgtgagaggctgaaacagaagttctacagaagtaggttagctgtaaggagctgaggattgaggagtcatatctgggggatattcctgccaccctcaagtccagggactttctgcactcaaaaaacttacgctcatgacaatgactgcctcattcaagaaaacccaagctgactggcaagaagccagcagcctgggtacttgttgctgcagcttagtaagtagcagaagagctcatcctcctcctctggaagaagccacttaacaggttctcatcctgactcctaaattccttaacagtcctttactcaggaataaaacaagtccaagaaaacttatctgtcccacaaatagtcctggaggcagtggagtaagatagggagagcaaattggtgtctgctcttgagtatcttgagggaatgggtatctagaggcagcaggatgaactggctttgatagcagagactttaaaatgtgtggaccattagttgtctttggatgtgctccctagaggctgcgcctgacacagggagctgtgtatacatgatttattaaaaggaaatcctcttaggagaaacatattagcaggataaacacaagaaagaatgcagttacaagtggagtctcaatcaatcccagaggaaattctgggacttcagcctcagcttgacctatgggggggctctggaatgtcagatttctcctgatcccaactgtgctctggggcttccattgcagccaagagagagcattccccagaaaactccaggtgaggagtctccagtggcccaagggtgatcctccagaggaggttacactgccgaactgggacattggcaccctggatttgaatatctagagagggcacccaatggtcatactaatgtttgccataacagtctcttctaggtctagacttgaagcatatggaagggtccttgggctagagccaacccaagcccaggctgactcccttttaatacttctaattttccctgaagatctggtcttctccctaccaccactaccctattacataagaggaaaggattggagaatgttcttgaaaagaatgtgatgctttcccatacaaggaatatactcaaggaaaaatttcatggcacaaaatgctgattctgtccaatttatcccatgaataaattgtgtacacatatatatatgaaaaattt

SEQ ID NO: 378736 - DNA, 3377 bp, Homo sapiens
gcgtctcttttctgttgtggcttttaagtgcccctgcagcactgagaatatgacctatgggctggttttcctctttgctcctgcctgggtgttactgatcctgggattctttctgaacaataggtcgtggagactcttcacaggctgctgtgtgaatcccaggaaaatctttcccagaggccacagctgccgtttcttctacgtcctcggccagatcactctgagctcattggtggctccagtgatgtggctttctgtggctctgctcaatggaactttctatgaatgtgccatgagcgggacgagaagttcaggactcctggaactgatttgcaagggtaagcccaaagagtgctgggaagaacttcacaaagtatcttgtggcaaaactagcatgctacctaccgtcaatgaagaactgaaactctcccttcaggcccagtctcagattctaggatggtgcctgatttgttcagcgtctttcttctctctgctcaccacatgttatgctcgctgccgatctaaagttagctaccttcagctgagtttttggaagacatatgcacaaaaggagaaggagcagttggaaaatacatttctggactatgccaacaagctgagcgagaggaacctgaaatgtttttttgaaaacaagaggccagatccttttcccatgcctacgtttgctgcctgggaggctgcttcagagctgcattctttccaccaaagccagcaacactatagcaccctccacagagtggtggacaatggtctgcaacttagccctgaggatgatgagacgacaatggtccttgtgggtactgcccacaatatgtagctcatccaccatcaatgactcatggtgttgagtggcatgctcattctgtgatcctcctaacgtatcaccagcaacctgtgtgtctctgtattttcttacatttggagtatgtttacaagacaataacacaaaggaaactgctttgaagctctcaagtggaacatcaggatgtgctcaaattgatgctgaggggtgacaaaggtgctcttgcattggtggagaggggctcagtaggcctaaatgttgctccaagatctaagattttatcattcaacagacagactcatgtgagagggctcatcagtctctgtaaatattggttgcagaatttaggggcagaagcaatggcttgtgagtgagcaagttactcttaacataggttgccctacacagtggctcctgcagtgtgatcagcaggagtctctgtcctacaaatctacacttttaaggatgtatgaaattgtggaattcattccctcaggatctgaagatctcagttctcaaaaatcacaagttgcaagaatatgatacctaaaattgaaagtttttcacatgttttcactgtatactgaaaatactcccctggaagcagggctgcatcataatttttgtgggctttatgtacttttgcctttgcgaaccatttcctacattcaaaatagtagtaacaaatatatatatatatatacacacacacacacagaaatatatatttataactgcattgataaaaggtgaatatattagcattttcttcaacctaaaagtttatgtattttcttctgattttaaaagaaattaaaaacattttagtgggcccttacaagtattatggtccttaggcacagtgcttactaggccgtgggtatgtcttagtgcgtttgggctactataacaaaatatcatagataggtggcttatacaaaatagaaatttatttctcacagttctggaggctgggaagtccgaggtcaggctgccagcatgctcaggttctggtgagagcaattttccaggttgcaaactgcttgctgacttctcagtgtccttccatggtggaaagtgcaaataagctcccttgagcatttttataaggcactaatcccattcctggaggctccaccttcatgacccaattacttctcaaggctctgcttcttagtactatcagcttgggggttaagatttcaacatatgaaattgggggagacacaaacattcagactatagtagggtaaattgaccttggctaaaggtctggggacactgtccaaagcagtactggcataaaactgcattgcagtcttacatttatcagaaataatgcaaatcttgcattctacaatgtactatatccatgttagtatgtacatatatatgtgtatgtatatatgtacataaattctccttaaatctctgagaagaattgtgctttaaaaaagaactatgttttgtgctgtggctcataccttacagtggtagtctatgtctcttagtttgagaaagctgaatattaacttcttattaacatgaaacatgatggcaaactgaatcctacaagtataggacccagaacatatctatgttattgtcatttacaagaagaaatatgtatttggtctttcttcctattcctggtgcagagctcctaaaacctttgggacctcccaagtgatgtgtctggtagtacgcgaatgagatgactgatagttaggggcttctgaatggcctcagaatagggtctggttgccacgggaaccaaccatgtgtttagagggttggaactttcagccccactcccagaccttggggaaggaagaggggctgaaggttgagtcgatcacaaatggataatgatttaatcaatcatgcctaagaataaagcttcccataaaaatctaaaggacaaggttcagagagcttctgcattgctcaatacatgaggagtggtgagcccaaaggggccgtggaagctccgtgccccttcccccaaacctgttcctgtgcctccatctggctgtttctgagttatattattttataatagactgatgatagtaaataaagccctttcctgagttctgtgagctactctagcaaatggtgaaatctgagaaggaaatcatgggaacctctgctttgtagccacgtcagatagaagatgtgagtaactttggaacctactgcttgtgactggtgtctgaagttgggggagatcttatgggactgagctcttaacctgctggggatctgcacttaatgccgattaatgccagaattgaattgtatgatatccagttggtattggagaattggccagtgtgggagaaaacccacacagttggtggcaaggagtgttcagtgttgagtgtgaatgtcaataaaaaaaggtttgttttttctacgtacaatatctttgggaacttggaggtgcagggtcagacgtctgtgtgtgtatgtggcagggacagaacagggattagggatgtgagggggtagagttttcagaataaagggagagaaaattcaaaaaagagtt

SEQ ID NO: 378737 - DNA, 3292 bp, Homo sapiens
gcgtctcttttctgttgtggcttttaagtgcccctgcagcactgagaatatgacctatgggctggttttcctctttgctcctgcctgggtgttactgatcctgggattctttctgaacaataggtcgtggagactcttcacaggctgctgtgtgaatcccaggaaaatctttcccagaggccacagctgccgtttcttctacgtcctcggccagatcactctgagctcattggtggctccagtgatgtggctttctgtggctctgctcaatggaactttctatgaatgtgccatgagcgggacgagaagttcaggactcctggaactgatttgcaagggtaagcccaaagagtgctgggaagaacttcacaaagtatcttgtggcaaaactagcatgctacctaccgtcaatgaagaactgaaactctcccttcaggcccagtctcagattctaggatggtgcctgatttgttcagcgtctttcttctctctgctcaccacatgttatgctcgctgccgatctaaagttagctaccttcagctgagtttttggaagacatatgcacaaaaggagaaggagcagttggaaaatacatttctggactatgccaacaagctgagcgagaggaacctgaaatgtttttttgaaaacaagaggccagatccttttcccatgcctacgtttgctgcctgggaggctgcttcagagctgcattctttccaccaaagccagcaacactatagcaccctccacagagtggtggacaatggtctgcaacttagccctgaggatgatgagacgacaatggtccttgtgggtactgcccacaatatgtagctcatccaccatcaatgactcatggtgttgagtggcatgctcattctgtgatcctcctaacgtatcaccagcaacctgtgtgtctctgtattttcttacatttggagtatgtttacaagacaataacacaaaggaaactgctttgaagctctcaagtggaacatcaggatgtgctcaaattgatgctgaggggtgacaaaggtgctcttgcattggtggagaggggctcagtaggcctaaatgttgctccaagatctaagattttatcattcaacagacagactcatgtgagagggctcatcagtctctgtaaatattggttgcagaatttaggggcagaagcaatggcttgtgagtgagcaagttactcttaacataggttgccctacacagtggctcctgcagtgtgatcagcaggagtctctgtcctacaaatctacacttttaaggatgtatgaaattgtggaattcattccctcaggatctgaagatctcagttctcaaaaatcacaagttgcaagaatatgatacctaaaattgaaagtttttcacatgttttcactgtatactgaaaatactcccctggaagcagggctgcatcataatttttgtgggctttatgtacttttgcctttgcgaaccatttcctacattcaaaatagtagtaacaaatatatatatatatatacacacacacacacagaaatatatatttataactgcattgataaaaggtgaatatattagcattttcttcaacctaaaagtttatgtattttcttctgattttaaaagaaattaaaaacattttagtgggcccttacaagtattatggtccttaggcacagtgcttactaggccgtgggtatgtcttagtgcgtttgggctactataacaaaatatcatagataggtggcttatacaaaatagaaatttatttctcacagttctggaggctgggaagtccgaggtcaggctgccagcatgctcaggttctggtgagagcaattttccaggttgcaaactgcttgctgacttctcagtgtccttccatggtggaaagtgcaaataagctcccttgagcatttttataaggcactaatcccattcctggaggctccaccttcatgacccaattacttctcaaggctctgcttcttagtactatcagcttgggggttaagatttcaacatatgaaattgggggagacacaaacattcagactatagtagggtaaattgaccttggctaaaggtctggggacactgtccaaagcagtactggcataaaactgcattgcagtcttacatttatcagaaataatgcaaatcttgcattctacaatgtactatatccatgttagtatgtacatatatatgtgtatgtatatatgtacataaattctccttaaatctctgagaagaattgtgctttaaaaaagaactatgttttgtgctgtggctcataccttacagtggtagtctatgtctcttagtttgagaaagctgaatattaacttcttattaacatgaaacatgatggcaaactgaatcctacaagtataggacccagaacatatctatgttattgtcatttacaagaagaaatatgtatttggtctttcttcctattcctggtgcagagctcctaaaacctttgggacctcccaagtgatgtgtctggtagtacgcgaatgagatgactgatagttaggggcttctgaatggcctcagaatagggtctggttgccacgggaaccaaccatgtgtttagagggttggaactttcagccccactcccagaccttggggaaggaagaggggctgaaggttgagtcgatcacaaatggataatgatttaatcaatcatgcctaagaataaagcttcccataaaaatctaaaggacaaggttcagagagcttctgcattgctcaatacatgaggagtggtgagcccaaaggggccgtggaagctccgtgccccttcccccaaacctgttcctgtgcctccatctggctgtttctgagttatattattttataatagactgatgatagtaaataaagccctttcctgagttctgtgagctactctagcaaatggtgaaatctgagaaggaaatcatgggaacctctgctttgtagccacgtcagatagaagattctcttctaggtctagacttgaagcatatggaagggtccttgggctagagccaacccaagcccaggctgactcccttttaatacttctaattttccctgaagatctggtcttctccctaccaccactaccctattacataagaggaaaggattggagaatgttcttgaaaagaatgtgatgctttcccatacaaggaatatactcaaggaaaaatttcatggcacaaaatgctgattctgtccaatttatcccatgaataaattgtgtacacatatatatatgaaaaattt

SEQ ID NO: 378738 - DNA, 227 bp, Homo sapiens
taggggcttatgcacagaagctatgtctgttctcaagcttctgttcattagtctgtgaactggggctgcagcgagaagagacagtggatccctgcaccattatcccctggtcccagggcttgtataccgtagggaaggggtgattcagagggatgtgtaggtcagtgtgagtacaataacatcaaagttgtttgacctaaggtcaggctttatggtaagttcttggt

SEQ ID NO: 378739 - DNA, 280 bp, Homo sapiens
ggagaatggcgtgaacccgggaggcagagcttgcagtgagcggagattgcaccaccgcactccagcttgggggacagagtgagactccatctcaaaaaaaaagaaattgtaataacacccacattatacatcagtgaaaactaaacacgttactaccctaggccttattgcacaggggtgctacctccaaggagaaatttgtctaggcagcagatggactagaggtgattagcctatgagcgaatgaggctacagatcattcctttttatctgattcctt

SEQ ID NO: 378740 - DNA, 475 bp, Homo sapiens
acatcactgaggactcagtttcttcccatctctctgctccaccatccgtggggttggcttctttctcaggcagtttcccctaagtggtcacaagatgtctactagccacaaatggaataagaggttcccttgtccatgtgcaccaggagacagaaacctcttcacagcctttcaatacatattgtcccttcttttgatctgatgtggccacttacatcatgaagggcagtaaccatactcaatgcccgcactgatgggcttacatccggcaggatccacctctagggctggggatggcttagctccagctatgccatatgactatgtgtagaagaaacaaggaagtggttaccttggggagaagtagagaacaaatgctgggtaagaaaccaatagcaccattaaaatggggccattgtacttcattgtgttattctttttattctctaaataaaacaaattctgaatataatct

SEQ ID NO: 378741 - DNA, 724 bp, Homo sapiens
atcaataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctctttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaa

SEQ ID NO: 378742 - DNA, 795 bp, Homo sapiens
gtttcaggtgcttcctgcgtctgtggagaaaacttttcccttgggcttctttggcttcttaggattgtcctcaaaaagaagttgaccttgggcaatctacttaactttccctggcttccatttcttatctagtgaaataattattataataaaacctcagtgggtaattgtgaggatgaaatatagtcttgtatctgaaagcatattgtagacttgtgcagtgttgactgttattcttcagtagcagcagggcggtgtggaaagctccaggacttggaatccacctaagcctttctttctgtaaatttagtgaaaataatactaaccttaaatggttgttttgaagattaagaaaactgaagtaaatagtaaagtaaatgttggttcgttcatttagtcgacagtaacaatatttccatttattctttctctaagttgatgtttatacagtgagttcaaactttttattcagactttctgagtgatcggtgcagtccctaattcatgggctgttttcctccatgaactctgtgaagcattattgctatttcttcttcacataaagaaatcaagattgaaagaagatttaaaaacttggcacaaggtcacacaactagtaaatattaggatcagaataaaacctaggtctgggtcagctgtggtggctgacgtaatcccagcactttgggaagccaaggtgggaggatcacttaaacccaggagtttgaggttgcagtgagctgtgattatgccactgcactccagcctgggaaacagagtgaaattccccattta

SEQ ID NO: 378743 - DNA, 189 bp, Homo sapiens
atggaccccagggaatgtgtctgcatgtctggaggaatctgcatgtgtggagacaactgcaaatgcacaacctgcaactgtaaaacatgtcggaagagctgctgtccctgctgccccccgggctgtgccaaatgtgcccggggctgcatctgcaaaggaggctcagacaagtgcagctgctgcccatga

SEQ ID NO: 378744 - DNA, 588 bp, Homo sapiens
taggcacatatgataattaaaagcagaacaactttcaattttattattttttttgaaaaattatctaactcacttcattgccctagaatggaccacctcttctatcccctccagccattggcacaaccttgctggaaatctcaaaaacatagaaatagctaagagtttgtcacaatctctggaatactctgcatttaccttttttttttttttttttttgagacaaggtctggctctactgctcaggctggagtgcagtggcgtgctctcagctcactgcaacctctgtctcctgggcttgagccatcctcccacctccgcctcccaagtagctgagactacaggcatgccaccatgcccagctaattttttttgtattttttgtagagacaaggtttcatcattttgcccaagctggtgtcaaattcttgagctcaactgattcacccacctcggactcccaaagtgttgtaattacaggtgtgagccacctcacctggccacatttgcttatcattcctaaatgacttcattgctgttttcttctcttcctttttctcctcctgtttgttcaattttaagcacttt

SEQ ID NO: 378745 - DNA, 397 bp, Homo sapiens
tttttttgagacagttttgttcttgttgcctaggctggagtgcagtgacacaatcttggttcactacaacctctgtctcccaggctcaaacaatgctcccacctcagccttcagagtagctgggactacaggcgtgcgccaccacgcccggccaatttttgtgatttttgtgttttttgccatgttgcccaggctggtctcaaactcctgggctcaatggatccacccacctcagtctcccaaagtgctgggattgctggagtgagccaccacgactggggcaaaagacatttcaaatgcctgaagaaacaaaagctggtttgagttagtactaacctcaccacttctgttttgtaaatataattattgatatcgcaagtcccaaatggtaacccat

SEQ ID NO: 378746 - DNA, 2048 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtc

SEQ ID NO: 378747 - DNA, 1341 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaagtgagtgcccccttacagctcttgctattaaatactcatttgatttctgggttgcacagcaatccctccgctgggagcaatgatatcaacaaatgctttcttaaaatacttattctttgatgtaggtcatgggagatagaaaaaaataagaaacgtcaggtctggaccttaaagagagcttatccagttgaggaaataagataaatatagacaaattcaagttgagtgacaatctggagaagaaaaatgagcaaagcaatacagaggtgggcgaagtggcatcagattggaggaagaaaggaaaacgcaaggatcttctgagagtcttgtctgctccctgcgattgaggccttggtagggggagccctttcactatactagaggcattttaggtgtggattttttgctagtatagtatattaaaatgattcattcctgtgctaagaaggatggaagatgagttgtaactcctaaattgaaataatgtgctgattattaagcagtcactccgcatctaagaactcgt

SEQ ID NO: 378748 - DNA, 2344 bp, Homo sapiens
gccccggctgtttttgaagcggggcccgggccccaccgggctgcggcgtccgactcgagtgagactctcccctgcggccccgccggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378749 - DNA, 1932 bp, Homo sapiens
ttgaggcaggagaatcgcttgaacctgggaggcagaggttgcagtgagccaagatcgtgccacggcactccagcctgggtgacagagcaagactgtcttggtgtggggggagatacagtaaaagcagaaagtatgaaggcagagtggcaaaaaaatctagatgatttaatcaaattaggctaaataaatggttcaattattaactttctataggttgttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378750 - DNA, 1125 bp, Homo sapiens
tagctcggtacccccttccctctctcacgatcctccctctctcacgagaaggtgacagtggtgaatgcagaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378751 - DNA, 1151 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaagtgagtgcccccttacagctcttgctattaaatactcatttgatttctgggttgcacagcaatccctccgctgggagcaatgatatcaacaaatgctttcttaaaatacttattctttgatgtaggtcatgggagatagaaaaaaataagaaacgtcaggtctggaccttaaagagagcttatccagttgaggaaataagataaatatagacaaattcaagttgagtgacaatctggagaagaaaaatgagcaaagcaatacagaggtgggcgaagtggcatcagattggaggaagaaaggaaaacgcaaggatcttctgagagtcttgtctgctccctgcgattgaggccttggtagggggagccctttcactatactagaggcattttaggtgtggattttttgctagtatagtatattaaaatgattcattcctgtgctaagaaggatggaagatgagttgtaactcctaaattgaaataatgtgctgattattaagcagtcactccgcatctaagaactcgt

SEQ ID NO: 378752 - DNA, 979 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtaaaaagcagcttccctaagaatgatttcctgtttcttttgccttttacattcattttggggttcctcatgaagacttgtgacagaactaaaagacctttctaagaacatcatgaatgggagatgacaagaaattatatgacctgtacttagtgtagatatttattaattacatttctgtgacctctagttagtgtagaaatgtattaattacatttagatgtgcttttccactagtgcctgctccttaaatattctccttagtagaagcacttttcctcctgagtttcgtatacttgaagcattctgaacccatgtttgcagtaagccattttagtcatgactgaaggctgagttaagtgatgtagtcatgaacttagcacactgcccagatgtgaaagtggtacaccatcaccatcttggtctgtggtactccgt

SEQ ID NO: 378753 - DNA, 410 bp, Homo sapiens
cctgaagcttcctgtactcatttaatagagattttccacacaagtgtgaagagtggttgttagaaaactgtgtgacttgattcgtccttgaatgcttgatggtccctattatttttctccataggtgtaaactgttttacaagaaagacaatgagtttaaagagaaaggcataggtactctgcatttaaaacctacagcaaatcagaagacacagcttttggtgcgggcagacaccaatttaggtgggtaccttttttcagttagcacaaaatcatcatcacatagtatataaaagcgtttaccctgctgactcaaggttattaatatgtttttaaacagagcgcattcaggccaaattcatcctgtatttacttatttatagttttgagtcccaggataatagtgtgta

SEQ ID NO: 378754 - DNA, 2528 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378755 - DNA, 2718 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378756 - DNA, 1865 bp, Homo sapiens
attctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagtgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378757 - DNA, 1297 bp, Homo sapiens
taagcgcgtatccgaatattagtatcttgacagcaatgacaagaaaaaagaggagcaccattacaagcagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtga

SEQ ID NO: 378758 - DNA, 198 bp, Homo sapiens
gggtatttatttttttctaaggatcatgttcttcctttttctttcttcttcactgtgtccccattcacctagctacttcagggcccagcttaaacctgacatccacctggaagctttccttgaccctcctaatttttgttgtttgccctcatctcacccccaactcaaagtggtctaataaaactttgtgcttcccct

SEQ ID NO: 378759 - DNA, 853 bp, Homo sapiens
tgaggctggaggatcgcttgagcccgtgagttcaaagctgcagtgagctgtgattacaccactgcattcagcctgggtgacagagcacaatactgtctcaaaaaaaaaaaaaaaaaaagaaggtggaggaaggccaggaagggcaggggatgctcctgagagggcagagtggtgggctgtgtcctggggaagggctaagggagtggaacagaggttatcgtggggtattttgtggttcttcagctcaattgtggaaagggaaagcaagttgggttagaaagaatagagtgaggtacagttaggagaaacttccaggtcttgagacgagtaagagttagggaaatcaaggaagaggcacctaactggcctcttgggaggggtgctcaggctgagtgaccaggaagctggcaggaagttgccttccaggggaggatgctggtaggggcgggtaatctggcagtttcagcttcctgttgttgctacgccttgggaacctggcaatgttgcccttggccaaggcccagcttgagctgtggcagcctgctccccaagccaaagaataagttaaaggtaaagggtgggctgggtgcggtggctcatgcctgtaatcccagcactttgggaagccgagccgggcagatcacgaggtcaggagatcgagatcatcctggctgacaaggtgaaacccggctctattaaaatacaaaaaaaagctgggcatggtggcaggcgcctgtagtcccagctgcttgggaggctgaggcaggagaatggcgtgaacccaggaggcggagcttgcgccagtgcactccagcctgggcgacagagcgagactctatctcaaaaaaaaaaa

SEQ ID NO: 378760 - DNA, 912 bp, Homo sapiens
tgaggctggaggatcgcttgagcccgtgagttcaaagctgcagtgagctgtgattacaccactgcattcagcctgggtgacagagcacaatactgtctcaaaaaaaaaaaaaaaaaaagaaggtggaggaaggccaggaagggcaggggatgctcctgagagggcagagtggtgggctgtgtcctggggaagggctaagggagtggaacagaggttatcgtggggtattttgtggttcttcagctcaattgtggaaagggaaagcaagttgggttagaaagaatagagtgaggtacagttaggagaaacttccaggtcttgagacgagtaagagttagggaaatcaaggaagaggcacctaactggcctcttgggaggggtgctcaggctgagtgaccaggaagctggcaggaagttgccttccaggggaggatgctggtaggggcgggtaatctggcagtttcagcttcctgttgttgctacgccttgggaacctggcaatgttgcccttggccaaggcccagcttgagctgtggcagcctgctccccaagccaaagaataagttaaaggtaaagggtgggctgggtgcggtggctcatgcctgtaatcccagcactttgggcacctaaggcaggcagatcacctgaggtcaggagttcgagaccagcccggccaacatggcgaaaccccatctctactaacaatttaaaaattagccagacgtggtggtggttgcctgtaatcccagccacttgggaggctgaggcaggagaatcacttgaatctgggaggcggaagttgcattgagctgatattgtggcactgcactccaacctgggcaacagagcaagagtctgtctcaaaaaaaaagataaagagtggccatctagggccgggcacggtggctccca

SEQ ID NO: 378761 - DNA, 450 bp, Homo sapiens
ccactttacatgcaagtgtagattaatttcttatttcccccttagtctagcttttaagcccttattccgaggaggccatggtactttttatctaaaccttaggccatccgtcgttccaagttaaatctagcctctccggagccacctcatcactaagataattctgtatctaatccctcatctaagccccttttctagacatcgttttttcttccctgcctcccatccctttccccaaatcattaccataaaagatagctgctcttcttttcttacattgacttaagataaactcatgttttcggctgttcttatcagttttttcttgatttaatactgtccttctaatctccatttataatcactttttattcatttatttttgaaactgaattacaccactgcactccagtgcagtgaatggacaggtgacaaagtgagactgtctca

SEQ ID NO: 378762 - DNA, 341 bp, Homo sapiens
aggatgtttacattttctagggaattgaccgttccatgcagagctacaatatagtacccgtatgtgctcagcagccatatgtggttactgtatatactataccgcatatggctactgagcactcgaagtgttgctagggcaatcctctctcagccttggaggaagatgtaaaatgtaggctgaacaggagcttgatttatgtattttgcaatatcaagttttcaagtactatttaacacataatagatcaataatggcaggaattttagagggccatgttcaggaactgaaaatcaatacataaatatgttctctcaagtaggtctaaagggtttaagata

SEQ ID NO: 378763 - DNA, 590 bp, Homo sapiens
ttacactgagacgacttcttttcttcattatttagggtggtttccctgcaacagttgatggccaaggatatcaaaccttaaactcagaacatggcaggtgagtaaaagttgaccctatttttcaaataaaagatcagtgttctcaaaacttacatatgtagtcttcttaaacagctccctcctccctccaaacaaactaccttgctggtccagcctgaacaacatgcacaaagactttggctcccctagaacaagccattgagccttcctcttgagataggggcatcaagaataaggattcacatgtttattcacaactcaggctcctcaaggggctgggatctccccaattagactcctttgtttcactatgcccacaatctcagaggtgtttgaaattgtctgtactagggaagaaaggattttcaaaaatagccagtcacacagaacagctctggaccaagccattacccaatcccggatgggaagttgcttcacgtttctcttaagttgttacgcagcattgccatggcagcaaaagaggttaaccattaaggaagaacctgttcaactgactgaaccaacaaaaa

SEQ ID NO: 378764 - DNA, 369 bp, Homo sapiens
accctgcctgctgttcgaataattcatattcttactgccaggactggctccaccaacagccctacccccaggccagggtctccacttctgaaaggagccagacagtcagagaggaccctaggctcctccatgtgacatggggttagccacacaggcaagacaggggcagggtccctggatgtgccctaatgacctgatggcccacaggctgctgaacccatggggtgcaagacaggcctgcatgggaactaccacccctccccaggagtgggtgctggggacagggctcgcgagaaacagggctacctgatcgtttcttctttcttgtaatcgtctggttccttaggagaaaaaaaaattgcttctttg

SEQ ID NO: 378765 - DNA, 531 bp, Homo sapiens
atgagcttttctttccccctttcttgtgtaaagtctattagaatttgctagtaaaatttaaaaaggtatgtgacatttcttaagataattgagaaagataaacttctttttcaggagggtccatcttcctgccatttcttgtgactggctataaattccatgcagtgctggaatgtgcttctcacagttagagtgctgagcacctgttttatttcacactcccttgattcctggggtaaatcccatctccgcagcatgggctccagttaaattcattagtggtccagatgtgtgtcccctgtcagctggccaagtaaccccactgtttatcgacaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgtaagcctttcctagctcatcccgttgaaattggtgttgtctgtgatgtcactgatctttc

SEQ ID NO: 378766 - DNA, 490 bp, Homo sapiens
aaactaggtattttgactcaattatggggactgaaagtactgcatgacttgtatgatctgttgctaactcaggtgtctaatcagcaagcctttcggatatattaataagctactaatcgtgtctgtgtctgtgtcagtgtctctctgtaacatgacctctcttctcttcctcctcctgctttcctttgttcagagaagcaacagaaaactcacccattctggatgggtctgagtctccacctcaccaaagtactgatgaatagaggtaccgtaaggggagttttattcctactgcccatgagtctgtggtcccacatgtgttgcttttgtccatgtcatcatttccacaaggatacatctgaatgctgtatttatgccttatttctagatacatggggaactggaactatgtttttagctgaaggttcttacatcaaaattatgatattcctaacactgcttcccagaaaagacccccagagtatgtttt

SEQ ID NO: 378767 - DNA, 472 bp, Homo sapiens
ccaccgtgcccagccattctactaaaacttttaaattaaacagtttaatgtcttttaagtacagcctattcctgtagcatctggccagagtaggttactatccttactcagtttctaaattatttatctatgcacttttctgggatttgccatatagataccactcctcttgtgaaaatccatttgaaggaaactttaaacttagatatttgagcaggaatatttgatgcagtgtcaagagcacgggatttggagttagagaggcccgagaactcacgctgacactgctcctcactggctgggtgaccttgcctggcacagaggaggcaggcaggaaatatctgttcacttaacaaatgaatgaaattcaagttttataatgaaagtcaaatggcaattacagaaatttactttggaaaaaactttggaagtgcaactattctacataagagacattgttagagaaatgaaa

SEQ ID NO: 378768 - DNA, 6816 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378769 - DNA, 6085 bp, Homo sapiens
ggaggaagctcagttcagcactccacgcagatggctaccgctccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccagttaaggaacctgcaggaaaatccacacccacattgcctggttttgaactggagagctgcgtgtgtgtgtgtatgtgtgtgtgtgtgtcaagcaagaggcggaggaggcacagactacggtctctgttttgataaggaaactgccagctgtcgaaagttaaccagcagagaggggaagatggcccaggagccagcccctcctgagttttaaactacactgttttctgtccagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378770 - DNA, 5853 bp, Homo sapiens
ggaggaagctcagttcagcactccacgcagatggctaccgctccctcctgagcgctcgctcctctcgctcctctcccctcacccgccgccttccctgctgggtccctctccccggtctccacctctcctccctctcctggaagggaaaagtctgccaagctggggactgccacgaccaaaccaacaaaggccgaccgaaggcggagaacttgaaaagaacttgttttgttccaatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378771 - DNA, 4632 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgca

SEQ ID NO: 378772 - DNA, 1424 bp, Homo sapiens
gaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatggagtctcactgtgtcgtgcaggctgcagggcagtggtgccatcttggatcactgcaatctccaatctctgcttcccgggttcaagcgattctcctgcttcatcctcctgagtagctggggttgcaggatgatgctcattccaagattttctgttttatttctgtcttttgcaatcgttggcctgctttgctgccataaatgagggaattgtggctaagagagcaatctgccggaagcatctcctcatccatcggtggacactaaccacagctataaccgggacaactagagacactgtccaagtcctctgtcaaattcacaacttagcttgcccttaggtgtgaatacagactgaccccagggccggaggggctgctgttgtgagcctttcctgctggaggggcctaaggactcagttccctttatctaagacaaaaccgaatggagacagtaagagcccatcacactccaccctccctccctcaccttcttgcagagctggtagagtgtagtggccaagagcaggtcctctgcggtgtcacaattggagacctcttctgaatccatccctcaccaactcagtgaccagagctggttacccaacctctcagtgcttcaggtttggtttgatgttttcaatctctagaatgcaacagtcgtagagttggtgagaagattatgcagctgtgctgaggaaagagtaagagctcaaacatgtcagctgtcattcaaatgtcactacaatggccttttttcaagtgtgatccacttgcaccaaaattacctgaggtgcttgtgacaaggatcttacagattcagtctccacggaaggttccagaagtgttttagtgatcgaggcaggggctctacagtcagacagacccaacttcaaatcttaccttgcaccttagttagatctgcgtgatgtgcaacaagttaatgcatttagcttcttggagtctttgtttcaataaattaagacattaatatctatcttgtttggcaaa

SEQ ID NO: 378773 - DNA, 1749 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgtaagcctttcctagctcatcccgttgaaattggtgttgtctgtgatgtcactgatctttc

SEQ ID NO: 378774 - DNA, 253 bp, Homo sapiens
agagcgccccttccccccactgctttttattaacagggaagcagatgtggggtctctcagacaagacagcggcccaagtggtatcagagagtgcgattattttctcagagggtgagtgcgtttctgggcattctctctttcagcgcaatgaagttgtgaggagtgacttgaagaagctgccagcccttcccacccaagccctgaaggagcacccttccctggcctactggtaagacccctggagtcttcccca

SEQ ID NO: 378775 - DNA, 673 bp, Homo sapiens
aagtcaaatggcaattacagaaatttactttggaaaaaactttggaagtgcaactattctacataagagacattgttagagaaatgaaatttcatttcttgacctcttacttaggcatagtgcttaatgtgaacatttctagcataagcgttgacctgtatcgaagtgcatgcgtgcatttttgtgtgcgtgtatgtgcgtgtgtgtgtgttctaggaagcagacacgccccactctgatttgtgctcactccgaatgccatttcacatatgcaggagctcacgggcaagctgccagtagaatatcccctggatccaggggaggaaccacccattgttcggagaagaataggaacagccttcaaactggatgaacagaaaatcctgcccaaaggagaggtgcgtccttcctttctgttgttggattctctcatgttatccttgtttttcccattggtcaggccttccaggttttctgtaccaatttcttcatttctgcctaatgccagtattttcgctcataccttttcttgagtgagctggccggtcagtatgtggttcccctcggtaggagtagtttgcttgcatttgcaggcatttgggtgtctgtcgaagttgcttgtctgacgctgtgggtctagcgcaagcagccacgttgagcttggggaaaacat

SEQ ID NO: 378776 - DNA, 496 bp, Homo sapiens
agtcatttgttggtggtatttaatgacgttcagacttcactccattcgtgtctaatcaaaagtgacgcatctcttcccatgcaatcccgcctgcagtggaggtttggcttgccctggtttggtttgactcgtcttgacttgtcttggcaactggggaagagtttcagggtttctcatcacaggggtgaaggtgtgggtttggctgtgtggctccaaggtgcgggtggaggggtgtaggggttctgtctcagcctgtgggaaggatgaccggggctcagttcctctcttcctgtctttgtgcagaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatga

SEQ ID NO: 378777 - DNA, 6820 bp, Homo sapiens
gaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378778 - DNA, 1763 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggtaggcagaggccagctggagggacgccccctgagcatggctgggaccccagaggggacccaggaaggtggggagagctgcagctggggagactgcagggcaagctgctccaaagctggctttgctttccagaccaaggttgggatccaaatgcgaatctgagaaaactgctcccaggaatcaaatagtggaagggaaaaaaaaaaaaa

SEQ ID NO: 378779 - DNA, 6029 bp, Homo sapiens
tccggtaccataaggcgcgtactgcgtctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378780 - DNA, 5598 bp, Homo sapiens
atgagcttttctttccccctttcttgtgtaaagtctattagaatttgctagtaaaatttaaaaaggtatgtgacatttcttaagataattgagaaagataaacttctttttcaggagggtccatcttcctgccatttcttgtgactggctataaattccatgcagtgctggaatgtgcttctcacagttagagtgctgagcacctgttttatttcacactcccttgattcctggggtaaatcccatctccgcagcatgggctccagttaaattcattagtggtccagatgtgtgtcccctgtcagctggccaagtaaccccactgtttatcgacaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcagagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtatctttacattttgcaaaacagtgttgtcaacacttattaaagcattttcaaaatgaaaag

SEQ ID NO: 378781 - DNA, 4219 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactgggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgttgctaataaacatcccacagtgcacgggacagctccacagccaagaccgaatgaactgcttgggctgttt

SEQ ID NO: 378782 - DNA, 1132 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaagatggagtctcactctgtagcccaggctgtagtgtaatggcataatctcggctcactgcaacctctgcctcctgggttcaagcgattctctgcctcggcctcctgagcaggtggaattataggcaccagccatcacacctggctaatttttgtatttttagtagagatggggtttcaccgtgttagtcaggccggtctcgaacgcctgacctcatgatccacccaccttggcctcccaaagggctgagattacaggcatgagccaccacacccagccaattctttttttaaataaataaataaataaatgta

SEQ ID NO: 378783 - DNA, 488 bp, Homo sapiens
taacgaggatgatgtgagttcagcatatctacctaaatgacactcttggaccagtaatcaagccttcagaactggaaaactcagagcaaaataagacaggttgagctcagactgcaagaaagtcccgagtggctgattgctatgaaggctgggttgtagaagtcttttctgggcatgaaaaagtacagtctatgattggagcaggtggtaatacaaccaaaatgctcaggaaactaaaattgttccctatcttataatattccaaattcctttgctctaagttctctcattgatttgccaggcttttttatcattcataatttagattacatggttgctatttggaagaaagaaaggaaggaaagaagggagcaaaggaaggagggagagagggagggaggagaaaagaggaatagaaggagagagaaacatctcgatgctttcttatccccaaagtttcaatcaaagttcatcattataatagggta

SEQ ID NO: 378784 - DNA, 586 bp, Homo sapiens
gacattgctctctggataaaggatagacttaggcactgatcagaaacggtctctgtttaccaaaattccttctttgcacacagagctgtgtagtgaaaatgcccgtcctacacaaataatgtgttatagcaaaatgagccagttaacatgtcagctcaaatcaacctaatttgggttaaaaattcttccttttctgtttttttttcttttcccccctccccctcctcaattcttccttttctaaaaggatcttgttacttcataaaaatcaaattggccccacgttaatttatttgggccatcagaacatgggagacttttgccaacatagctatagaacctctgtttttgtttgattttatgacagggatggggtctcactgtgattacaggtgtgagctgccatgcccaaccaaaatctcttcatagatgcgaagtttgggaagctgtgccaggtcccagattcacctccagtgtgactccggggtcgggagtaggtcccttgagagccccagtcactggacttcacaggcagctaaaatgcaggaagaggttgggaagtcagggccactgatctgcttcagta

SEQ ID NO: 378785 - DNA, 4305 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378786 - DNA, 789 bp, Homo sapiens
gcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccagg

SEQ ID NO: 378787 - DNA, 563 bp, Homo sapiens
gccttggcagatgaaggaagtgggagaggctgaaggaggcatcgaggtcagtgaaggcgacactggggctggtgggctgctctcagtgttgactcttctcacctaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaaggtcttggggaataggaggcagccaacataggggagttggggaagatgcccacgatgttgtcagtgtgggcaagacactggggctgggctggctggggcttttgccattttggaagttctggaaggcaacaggcaatagatgggggctgcccaggagggagtcaccatcctccctagagagttcagtcagcaaaccgttactg

SEQ ID NO: 378788 - DNA, 4779 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaaaaaaaaaaaaaaaaaaaaaaaaaaaaaaaaaacaaaaaaaaaacaagaaaaaacaaaaaaaaaaaaaaaaaaaagaggcgggcggcgcgccccgcgttaataatagtccccctacgcgggggcccaccgacatcgatgcagccccccattttttttgggacaagggcgggccccaaatgagaggggctgtatttaataatacaagacgagcacggcgccgcgttatcaacaccaccggcagagccgaaaaaactgcgccacgtgacctcatttgggaaggaaaccccaccacctcggggggggagacaagaatgagagagccacccacccaaaagaaatataaaaccccccgaggcaggaaaaaaaacacataagcggggattaaggtggggtgacaccaaccggcagtatagatgaccgcgcgaaaaaaacatctgcacaacgcgataatgtagaacacaattaccggcaggg

SEQ ID NO: 378789 - DNA, 4252 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaatgaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378790 - DNA, 4268 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaagttgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378791 - DNA, 4110 bp, Homo sapiens
gcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378792 - DNA, 4085 bp, Homo sapiens
agaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378793 - DNA, 3431 bp, Homo sapiens
  misc_feature (17)..(17): n is a, c, g, or t
ggcaggcttgtacgccngggaagtaaaggatatcgggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378794 - DNA, 1791 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccagctccaggccacatgcaatgtccacaagtctgccttcaatgactggttcagtgacacctcaacttccagattgagcaccatgtttttccagctt

SEQ ID NO: 378795 - DNA, 1562 bp, Homo sapiens
gcactttgtgagatccaccccctgcccacaacaaattgctcctaactccaccgcctatcccaaacctgtaagaactaatgataatcccaccaccctttgctgactctcttttcggactcagcccgcctgcacccaggtgattaaaaagctttattgctcacacaaagcctgtttggtggtctcttcacatggatgtgcgcgaccaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378796 - DNA, 1290 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatcagcaaacaggaatacgatgaagccgggcttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaaaaa

SEQ ID NO: 378797 - DNA, 1008 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagctgggaaccgaagaaaaatatacatgcagaaaaaggctggccaaggggcccataaaacaaatggtcccgaattctagtc

SEQ ID NO: 378798 - DNA, 354 bp, Homo sapiens
tggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtcccccaaacagcattttctcattagcctgaggctcttgttctgcaaccatgtgaagggagtgaccaagacagtctcatgtcccttcctcagccagc

SEQ ID NO: 378799 - DNA, 1280 bp, Homo sapiens
tgtactttaacccgttttaaagtacgtttgccattctcagggcaactgaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378800 - DNA, 4747 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaacaaaaaaaaaacaagaaaaaacaaaaaaaaaaaaaaaaaaaagaggcgggcggcgcgccccgcgttaataatagtccccctacgcgggggcccaccgacatcgatgcagccccccattttttttgggacaagggcgggccccaaatgagaggggctgtatttaataatacaagacgagcacggcgccgcgttatcaacaccaccggcagagccgaaaaaactgcgccacgtgacctcatttgggaaggaaaccccaccacctcggggggggagacaagaatgagagagccacccacccaaaagaaatataaaaccccccgaggcaggaaaaaaaacacataagcggggattaaggtggggtgacaccaaccggcagtatagatgaccgcgcgaaaaaaacatctgcacaacgcgataatgtagaacacaattaccggcaggg

SEQ ID NO: 378801 - DNA, 4205 bp, Homo sapiens
taaaaacgaagcacaattatagcggcgctattcataagcatctgagcctagaccgagcccgcgctaagcctctgccggcgcgcgtcaggcactgtggcccgaccgtgcgcgagacgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378802 - DNA, 4116 bp, Homo sapiens
aattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378803 - DNA, 2125 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactccaaaaaaaaaaaaaaaaaaaaaaaaaaaaaaaacaaaaaaaaaacaagaaaaaacaaaaaaaaaaaggggggggcgccccaaaaaaaataaccccccggggggcccctttttccccctccccccttttttttaaaaggggggcccccaaaggggggggccgttaataaaaacacgaaggagcggcgccgggtaaacacccgcgcgcggggggaacgacccgtgctcgcggggctcttggtggggggagcgccccacctttgtggcgcgcggcacatggctgacccaccccaaagggagtttaccgggccacggaaaaacaacactagcggtttggtggtgcccgcaatctcgccgggaagcctgcgtcgtttttgacgcttccgtttacactactatttgtcatatttgccgttgctcacgtaacataacgctattcctactctcgcgagtcacaactagctga

SEQ ID NO: 378804 - DNA, 1517 bp, Homo sapiens
acgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcaccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaa

SEQ ID NO: 378805 - DNA, 1072 bp, Homo sapiens
  misc_feature (9)..(10): n is a, c, g, or t
  misc_feature (13)..(13): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (31)..(32): n is a, c, g, or t
  misc_feature (874)..(874): n is a, c, g, or t
  misc_feature (876)..(876): n is a, c, g, or t
  misc_feature (881)..(882): n is a, c, g, or t
  misc_feature (888)..(888): n is a, c, g, or t
  misc_feature (890)..(890): n is a, c, g, or t
  misc_feature (894)..(894): n is a, c, g, or t
aaggcgagnngangctgggnnganncngngnngcaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgaagcctcactgagtcacttccaagttgtccatggctctggtctggatgggccactttccattcgccaangncgggnngcgggngnaaanccatgggatgggggtggagccaccttcactggtattgcggcttatgcggaaacgctgtggtggtgagctgctcggtaagtgggcgcacctaaggtccgggaaaaaaaacaaagaaacacacaaacgctgggggagagctctcacagggctaagcaagaccacaggtccttttcttctc

SEQ ID NO: 378806 - DNA, 640 bp, Homo sapiens
  misc_feature (41)..(41): n is a, c, g, or t
acacctagaggattacgctgatcgcttaggtgcaagtcttnaacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378807 - DNA, 563 bp, Homo sapiens
  misc_feature (12)..(12): n is a, c, g, or t
  misc_feature (543)..(543): n is a, c, g, or t
  misc_feature (562)..(562): n is a, c, g, or t
attcggcacagngtttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacatggcgacagtgctatagagcacgtgcttcacatcaggaggtgtcanccagctcattcagatctgnc

SEQ ID NO: 378808 - DNA, 1097 bp, Homo sapiens
gtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctgaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378809 - DNA, 1516 bp, Homo sapiens
gaagggcttgttgccccagtggccagcagtgtggccagcaggcagttttcaactgtcagcccctttggggatgttccctgcttcagagagctctcctcagtcactggatgcccttcctcatccagtgattgaatgaggtaggggttataatgttccagatattttggacccaacgtaggctgagtgacaggccaccgtagccccagagctccctgcgggggtggctgaggctgccatgggcctctgttgccacttaacctctccctcttccctgtcctgcttccttctccccctcacaaatgttgattctgaaagtactctctaatcgaaatcctgcattccagaccccacctcagagttcactccccgagagcccaacctgcaacacgtcaagcagactgccaccctgtcagtccatggctgatggaggacagatgacaagatataccctgggctgctgccagtagcagcccctcaagccttggtagggtctggagtcagactcagccaccactgacctagcccctactccaagttgaccatcttcagagccgggtactcactggatcttcacacactctttgttagaggaatgactcccccaggtttcggatggagaaactgaggtcccaagaagggtggtcacagaccagaagccagcttcagcactttctcccagcattaaccccaggggaggtgagggatcacccatctttccccctccctcttgggaacagttgattcacccagcagcactaggaagagaccccatgccctggccactgggctagctcctgtccaggccccattgtaatcgaatcccaaatcaggagccttccccagctccatgatgtcggggaggaggaggaaaggtcaggggccagctgggtggtgccaatccattggccctaccttaaagacaaacatctcgccccggaagagggccactgtgttgaagttgccgtcacagatgttgggtttggtgcctggtgtggatggccggtccccgaggggcggccgagggggcctgggctggcgctcgtgtttcctctccgatggtgagtggatcctgcggacggggagtgtagggagtggccttgtgggctccagaggctcggctgggggtcctggagagaggagctgcatcttagagagggggcagccgtttcccgcctcccattgccagtctcagcatcacccaggcagctctgagacaagtctgtcccagttcagcctcctgttccctctccccagtttaactcccccagtctttgagaaaatggatgaaaatagccattagaatgggactctcatctttccatccccgaatctggtatcttctcttttctctctcctgttacagagcaatcatgtccttccttagggtcagcgctcttccttaggccataccctctttgcccccttcacacgcactggccccacttcctcacccccttcatttattctctttcccaccccagtgcagcttctacccgtcacccactccaactgctct

SEQ ID NO: 378810 - DNA, 487 bp, Homo sapiens
tcacttgagagtgaggtgggctctgtgaaacagctactgaccgtgcgctttcctttctcttcagcctcacctgagtcaccttccaagttgttccatgggctcctggctctggactgtggccaaccttctccacattcccgccaaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccggaaaaaaaaaaaaaaaaaaactgggttttgggggggaaaggggtaaagggggtagtttcggcgcctttgtgaagggacgggccatggggtatcgaggaggtgtggaggagggaaaaaaaaaggaaagagatagggacgg

SEQ ID NO: 378811 - DNA, 1095 bp, Homo sapiens
  misc_feature (9)..(10): n is a, c, g, or t
  misc_feature (13)..(13): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (31)..(32): n is a, c, g, or t
aaggcgagnngangctgggnnganncngngnngcaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378812 - DNA, 1832 bp, Homo sapiens
  misc_feature (1581)..(1581): n is a, c, g, or t
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggaaaaaaaaaaaaaaaaaaaaaaaaaaaaaaggggggggggtcaaaaaatttcccccgcgagaggggcccccaagctttaagcgccgttaccccggtcttttctggttcacaaggggggcccctaatgaggggagctccgtaataaatagagcctagggccacagggcgccagcagcgtttaaacacacggttgcgggacatcgtgggaaacaccggcctaagccgtgggagactcctgtgggagaagccagacccacttatacttttcgtgggggggggtgcgacccaataattgggcgacnagacttttactctaagaggagaggattttcgagagagctctcctaagaggggtaacatctttttaaaagatgcttttcacaggggtgtgtatatacaggtgtggttttcacacatctgagccggtgacatatatagagtccatggagcgggcttgtggaaaaaagttatggggcgatataacgggagagttaagtgacaatttgtagtgaacaaatttttttattaccagcgggggactgcggggagaaaa

SEQ ID NO: 378813 - DNA, 1271 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcccggtacatgcaagttgcatgtaccgggccgggcctggcgtgcgggaggcggccacgacggcgcctttctcccaggaactccgggagggaccccaggactcagcgccag

SEQ ID NO: 378814 - DNA, 1433 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctgaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccggaaaaaaaaaaaaaaaaaaactgggttttgggggggaaaggggtaaagggggtagtttcggcgcctttgtgaagggacgggccatggggtatcgaggaggtgtggaggagggaaaaaaaaaggaaagagatagggacgg

SEQ ID NO: 378815 - DNA, 2987 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcctggatctatcattactgcaaaaacctgctctgttgtgctggctggcaggccctgtggctgctggctgagggttctgctgtcctgtgccaccccattaaagtgcagttccctccggataaaaaaaaaaaaaaaaaaaaaaaaaaaaaaaaaaaaaaaaaaaaaaaaaaaaaaaaaaaaaaaaaaaaaaaaaaaaaaaaaccccgggttttttttttttttttttaaatagttgacactcaattttattgctaaaaaaaatgtcctctggagtgacagcaggtatttgtcctcaacctctccccagagtccctgggagtgtttctgttattgtggagggaataggggatctggggacagggtgggacgtaccatggggacaggaggtcacagaacacacacacacacacacacacacacacacacacgtgcacacacacatccccccacaactacagccgccaaaataaccagcatggtgttgtaacatccccccagtgggggctagaattccccatggtgacctgtgacctgctccctgagacaggggaggccaggcaggtcacggtggggacgcagcagaacattatttctccatcttgctgttttctagccttgagttggggacatgagtgagaactgggggttttgaggagtaacccttgtgaacacatgtactccagcagccaggcatcccagatctcctgtcctggagggtgctggggcccctggctccccagagtgtgcaggcagacccccagagccctagctcatccatttatccattcctcataatccagtgtccaaagagcacccccagcagggcagggaaggtccctcccggggtttacatgactgattccttctcagaggcgaccgtggcatcccctgcgggcccccgatagtgtttgaggagggggtttccttcctcagtggggagtggcagcggatccaggggcagctcactcttcacttgtatcaactcaggctctgtgcttctcgactccgtacggtccacgtaattttggaggagtcctgcccccagagcgtcaccttctacattgaggacggtacaggaccggtcgactagccagtccacagccaggatcaaggagatatggtcgaccgggaggttgactgcttcgaggatgatggccagagtgaggacacctccagcagggatgcccgctgcccccacgctggacgctgtggccgtgaccaggatggtgatgatctttacgaagtccaaggactgctggctgagctgtgcaatgaacactgcggccacgcactggaagagcgcggcaccgtccatgttgacggtggcgccgatgggcaggatgaaacggctgatgtgcttggccacgccattattctcctccacgcacttcatcatcagcggcagcgtggcggaactggaagaggtcccaaaggcagtggccagcggcgtcacgatgccccacaggaagcggtaggggtttttgcgggtgaagaggaagtagatgaggggcagtaccaggagcccatggatggcgtgacccagcaggcagcacagaatgtacttgccaaggcgggcaaagagtaaacccacatcctccatctccacgatcttgccagccaccaggaacatgatgcccacaggggcgtaccacatgatccaggagaccagaaccatggtggcctcattgaaggagttgaagaagcggataagcagctccccttcaggccccagcttccgcagcgccacaccaaagacgatggcaaacactaccaagcccaggatgttcatcccctccacctcctgccccacgggcaccttcaccctggttccggtgatattcctctcttcataggtggtagagtatgagcgaaaggctgctgacaccaggttggaaggg

SEQ ID NO: 378816 - DNA, 1278 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtgggcaaaccttctccaattccggccaaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378817 - DNA, 1048 bp, Homo sapiens
  misc_feature (7)..(7): n is a, c, g, or t
  misc_feature (15)..(15): n is a, c, g, or t
gcgtggngagtgtgnttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378818 - DNA, 1256 bp, Homo sapiens
  misc_feature (1058)..(1058): n is a, c, g, or t
  misc_feature (1060)..(1060): n is a, c, g, or t
  misc_feature (1065)..(1066): n is a, c, g, or t
  misc_feature (1072)..(1072): n is a, c, g, or t
  misc_feature (1074)..(1074): n is a, c, g, or t
  misc_feature (1078)..(1078): n is a, c, g, or t
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgaagcctcactgagtcacttccaagttgtccatggctctggtctggatgggccactttccattcgccaangncgggnngcgggngnaaanccatgggatgggggtggagccaccttcactggtattgcggcttatgcggaaacgctgtggtggtgagctgctcggtaagtgggcgcacctaaggtccgggaaaaaaaacaaagaaacacacaaacgctgggggagagctctcacagggctaagcaagaccacaggtccttttcttctc

SEQ ID NO: 378819 - DNA, 2306 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgaccccacctcagagttcactccccgagagcccaacctgcaacacgtcaagcagactgccaccctgtcagtccatggctgatggaggacagatgacaagatataccctgggctgctgccagtagcagcccctcaagccttggtagggtctggagtcagactcagccaccactgacctagcccctactccaagttgaccatcttcagagccgggtactcactggatcttcacacactctttgttagaggaatgactcccccaggtttcggatggagaaactgaggtcccaagaagggtggtcacagaccagaagccagcttcagcactttctcccagcattaaccccaggggaggtgagggatcacccatctttccccctccctcttgggaacagttgattcacccagcagcactaggaagagaccccatgccctggccactgggctagctcctgtccaggccccattgtaatcgaatcccaaatcaggagccttccccagctccatgatgtcggggaggaggaggaaaggtcaggggccagctgggtggtgccaatccattggccctaccttaaagacaaacatctcgccccggaagagggccactgtgttgaagttgccgtcacagatgttgggtttggtgcctggtgtggatggccggtccccgaggggcggccgagggggcctgggctggcgctcgtgtttcctctccgatggtgagtggatcctgcggacggggagtgtagggagtggccttgtgggctccagaggctcggctgggggtcctggagagaggagctgcatcttagagagggggcagccgtttcccgcctcccattgccagtctcagcatcacccaggcagctctgagacaagtctgtcccagttcagcctcctgttccctctccccagtttaactcccccagtctttgagaaaatggatgaaaatagccattagaatgggactctcatctttccatccccgaatctggtatcttctcttttctctctcctgttacagagcaatcatgtccttccttagggtcagcgctcttccttaggccataccctctttgcccccttcacacgcactggccccacttcctcacccccttcatttattctctttcccaccccagtgcagcttctacccgtcacccactccaactgctct

SEQ ID NO: 378820 - DNA, 1184 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgatggagtctcgctctgtcacccaggctggagtgcagtggcgcaatctcgg

SEQ ID NO: 378821 - DNA, 1136 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagccgcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378822 - DNA, 1689 bp, Homo sapiens
  misc_feature (1438)..(1438): n is a, c, g, or t
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagccgcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggaaaaaaaaaaaaaaaaaaaaaaaaaaaaaaggggggggggtcaaaaaatttcccccgcgagaggggcccccaagctttaagcgccgttaccccggtcttttctggttcacaaggggggcccctaatgaggggagctccgtaataaatagagcctagggccacagggcgccagcagcgtttaaacacacggttgcgggacatcgtgggaaacaccggcctaagccgtgggagactcctgtgggagaagccagacccacttatacttttcgtgggggggggtgcgacccaataattgggcgacnagacttttactctaagaggagaggattttcgagagagctctcctaagaggggtaacatctttttaaaagatgcttttcacaggggtgtgtatatacaggtgtggttttcacacatctgagccggtgacatatatagagtccatggagcgggcttgtggaaaaaagttatggggcgatataacgggagagttaagtgacaatttgtagtgaacaaatttttttattaccagcgggggactgcggggagaaaa

SEQ ID NO: 378823 - DNA, 1106 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcctgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378824 - DNA, 1214 bp, Homo sapiens
  misc_feature (9)..(10): n is a, c, g, or t
  misc_feature (13)..(13): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (31)..(32): n is a, c, g, or t
aaggcgagnngangctgggnnganncngngnngcaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378825 - DNA, 1043 bp, Homo sapiens
  misc_feature (9)..(10): n is a, c, g, or t
  misc_feature (13)..(13): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (31)..(32): n is a, c, g, or t
aaggcgagnngangctgggnnganncngngnngcaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378826 - DNA, 839 bp, Homo sapiens
  misc_feature (9)..(10): n is a, c, g, or t
  misc_feature (13)..(13): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (29)..(29): n is a, c, g, or t
  misc_feature (31)..(32): n is a, c, g, or t
aaggcgagnngangctgggnnganncngngnngcaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378827 - DNA, 954 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378828 - DNA, 1645 bp, Homo sapiens
tgagccaacacgcccggcagctcagtttttaagtagcaaaatatacagctaatgccaagagctcagcttccctcccagttggtgatggtgaagtaggcaggatttattgggattcctgggtggtctctggcctgccctgggtgttttccagatcagtgggttggagggctgggctctgggcctagagctttcctgggaaagctgattgggctgggctgagtggtatcctcagcccctagggctcagcaggcatcttgtgtattcaccctctaatttgggtttctccagggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggtgaggcagcccaacttgacccaagagtcacagggccatcctagtcagtggttagccactgttctttcccaacaggcagcaattaggggtctctcctgtggtttttctatatgggctcttgagtttcaggtactcattggaatagtgataacagaggccttatcaagtgtcagaaagaagctggggagggtatgaatccttcatgattggggagattgaaccatccagtcctgcatcctgggccaggataggtgattgactgttgaacttttgactgtgggtgagaggggaaagaagtgatattgagaccagcctccagctgttcagggcatgcatgaatattaggggcttcacagctgcccttgactctgctctaagctgtacttcctcctttctctgggtgaggctttcatatgaggtacagaggagaaatgaggggctcagggagccaaggcctggatgcttctgggcatggagaaccttggttctggggctgtaagttctgagccctgaacacaatatctttgattgacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378829 - DNA, 976 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagaccagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378830 - DNA, 512 bp, Homo sapiens
caatggtttggcacaggacagcagaaccctcagccagcagccacagggcaggtttttgcagtaatgatagatccaggcgataagcacaggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378831 - DNA, 1108 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctgaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccggaaaaaaaaaaaaaaaaaaactgggttttgggggggaaaggggtaaagggggtagtttcggcgcctttgtgaagggacgggccatggggtatcgaggaggtgtggaggagggaaaaaaaaaggaaagagatagggacgg

SEQ ID NO: 378832 - DNA, 513 bp, Homo sapiens
  misc_feature (493)..(494): n is a, c, g, or t
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacacgaatgttcaggtannagctcgagtctatcatgta

SEQ ID NO: 378833 - DNA, 1009 bp, Homo sapiens
  misc_feature (811)..(811): n is a, c, g, or t
  misc_feature (813)..(813): n is a, c, g, or t
  misc_feature (818)..(819): n is a, c, g, or t
  misc_feature (825)..(825): n is a, c, g, or t
  misc_feature (827)..(827): n is a, c, g, or t
  misc_feature (831)..(831): n is a, c, g, or t
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacgacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgaagcctcactgagtcacttccaagttgtccatggctctggtctggatgggccactttccattcgccaangncgggnngcgggngnaaanccatgggatgggggtggagccaccttcactggtattgcggcttatgcggaaacgctgtggtggtgagctgctcggtaagtgggcgcacctaaggtccgggaaaaaaaacaaagaaacacacaaacgctgggggagagctctcacagggctaagcaagaccacaggtccttttcttctc

SEQ ID NO: 378834 - DNA, 898 bp, Homo sapiens
gtgactcggtctacattatccgctcgagctgcccaacggcatacacgtgtccagatggcttgtatcgaacatggtcctatacatcaatcgtatgataagccaagcgcaacgtgtccgacgatacttaccacagtgttggactgggacaactgctacgttgagccatctccgtgatggacaccttatatctgcggtgggagttcttggaccgcctatctatagagatcaagcgctctcatccgcgtggttcctcaacatttaccacgcgtctaaggtgtgccaactaattcgcatatagctctgcctcgcgtacgacgagtctagcttaacgtgaggtaggtgatgatgacttgatcacattctattcgaccggagctactagatagcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcctgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378835 - DNA, 1125 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378836 - DNA, 3564 bp, Homo sapiens
cagacccaagccgggttttattgaaatgccaggagcaggcacatgtcaaagtagccaaggaaggggggacagtggtacaggctgtgtaagttggcagggatgggcaagcctcatgtccatggtcctggcatcccctctgccaggggataagtaggcacaactaccctcccctcaaaatggcatgctcaggccagtggggcccctacccctggaccatgaaggctccaagaagggctggaagcactaagttttctctctcctgagggggaaggaaagaaggggagatgcaggaggaaggggaggtatagcgggggatgagcgttccaagaagtctctccttctaggtgtctgcacccaactcatggtgctgggcagtggagaggagcagcattacaaagggaggctgaaggctcatccctcagggaaccggagccccccagcctgtggggcttgtgtcagccctgaacagagggcagaagttcaaggggactgaagatgcaggtagttcccaagtgacctaggagtccccagagctggggggtgtggccttcatgggacaaggaggaagacaggaggatccaaccccagcatggaggggggagtgggcagtctccccaatttggcccctctaggtcagttccacgttgttggcacggtcaagcactcgggagccacgggcactacccccaagctggaaacggctctcatagagagtggggcagagcctcgtgccgaattcggcacgagggttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgccgcctggatctatcattactgcaaaaacctgctctgttgtgctggctggcaggccctgtggctgctggctgagggttctgctgtcctgtgccaccccattaaagtgcagttccctccggataaaaaaaaaaaaaaaaaaaaaaaaaaaaaaaaaaaaaaaaaaaaaaaaaaaaaaaaaaaaaaaaaaaaaaaaaaaaaaaaaccccgggttttttttttttttttttaaatagttgacactcaattttattgctaaaaaaaatgtcctctggagtgacagcaggtatttgtcctcaacctctccccagagtccctgggagtgtttctgttattgtggagggaataggggatctggggacagggtgggacgtaccatggggacaggaggtcacagaacacacacacacacacacacacacacacacacacgtgcacacacacatccccccacaactacagccgccaaaataaccagcatggtgttgtaacatccccccagtgggggctagaattccccatggtgacctgtgacctgctccctgagacaggggaggccaggcaggtcacggtggggacgcagcagaacattatttctccatcttgctgttttctagccttgagttggggacatgagtgagaactgggggttttgaggagtaacccttgtgaacacatgtactccagcagccaggcatcccagatctcctgtcctggagggtgctggggcccctggctccccagagtgtgcaggcagacccccagagccctagctcatccatttatccattcctcataatccagtgtccaaagagcacccccagcagggcagggaaggtccctcccggggtttacatgactgattccttctcagaggcgaccgtggcatcccctgcgggcccccgatagtgtttgaggagggggtttccttcctcagtggggagtggcagcggatccaggggcagctcactcttcacttgtatcaactcaggctctgtgcttctcgactccgtacggtccacgtaattttggaggagtcctgcccccagagcgtcaccttctacattgaggacggtacaggaccggtcgactagccagtccacagccaggatcaaggagatatggtcgaccgggaggttgactgcttcgaggatgatggccagagtgaggacacctccagcagggatgcccgctgcccccacgctggacgctgtggccgtgaccaggatggtgatgatctttacgaagtccaaggactgctggctgagctgtgcaatgaacactgcggccacgcactggaagagcgcggcaccgtccatgttgacggtggcgccgatgggcaggatgaaacggctgatgtgcttggccacgccattattctcctccacgcacttcatcatcagcggcagcgtggcggaactggaagaggtcccaaaggcagtggccagcggcgtcacgatgccccacaggaagcggtaggggtttttgcgggtgaagaggaagtagatgaggggcagtaccaggagcccatggatggcgtgacccagcaggcagcacagaatgtacttgccaaggcgggcaaagagtaaacccacatcctccatctccacgatcttgccagccaccaggaacatgatgcccacaggggcgtaccacatgatccaggagaccagaaccatggtggcctcattgaaggagttgaagaagcggataagcagctccccttcaggccccagcttccgcagcgccacaccaaagacgatggcaaacactaccaagcccaggatgttcatcccctccacctcctgccccacgggcaccttcaccctggttccggtgatattcctctcttcataggtggtagagtatgagcgaaaggctgctgacaccaggttggaaggg

SEQ ID NO: 378837 - DNA, 1268 bp, Homo sapiens
gtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctgaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378838 - DNA, 401 bp, Homo sapiens
gtgaccttgaggatccaatcgccacgacaaggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcgctccttgtcgtgcgattggggatcctaaagagcgaccccagcaac

SEQ ID NO: 378839 - DNA, 1279 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378840 - DNA, 1088 bp, Homo sapiens
  misc_feature (12)..(12): n is a, c, g, or t
attcggcacagngtttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378841 - DNA, 1297 bp, Homo sapiens
  misc_feature (1242)..(1242): n is a, c, g, or t
  misc_feature (1253)..(1253): n is a, c, g, or t
  misc_feature (1259)..(1259): n is a, c, g, or t
  misc_feature (1280)..(1280): n is a, c, g, or t
  misc_feature (1293)..(1293): n is a, c, g, or t
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgttggttgcttgggcttgaggggttnttgttgttccntgttgnccaaccccatttaaaagttgncagttttcccttncggg

SEQ ID NO: 378842 - DNA, 1071 bp, Homo sapiens
gtgaccttgaggatccaatcgccacgacaaggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378843 - DNA, 1252 bp, Homo sapiens
gtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378844 - DNA, 1782 bp, Homo sapiens
cagacccaagccgggttttattgaaatgccaggagcaggcacatgtcaaagtagccaaggaaggggggacagtggtacaggctgtgtaagttggcagggatgggcaagcctcatgtccatggtcctggcatcccctctgccaggggataagtaggcacaactaccctcccctcaaaatggcatgctcaggccagtggggcccctacccctggaccatgaaggctccaagaagggctggaagcactaagttttctctctcctgagggggaaggaaagaaggggagatgcaggaggaaggggaggtatagcgggggatgagcgttccaagaagtctctccttctaggtgtctgcacccaactcatggtgctgggcagtggagaggagcagcattacaaagggaggctgaaggctcatccctcagggaaccggagccccccagcctgtggggcttgtgtcagccctgaacagagggcagaagttcaaggggactgaagatgcaggtagttcccaagtgacctaggagtccccagagctggggggtgtggccttcatgggacaaggaggaagacaggaggatccaaccccagcatggaggggggagtgggcagtctccccaatttggcccctctaggtcagttccacgttgttggcacggtcaagcactcgggagccacgggcactacccccaagctggaaacggctctcatagagagtggggcagagcctcgtgccgaattcggcacgagggttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378845 - DNA, 1237 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtcggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378846 - DNA, 1476 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctggtgattctgctgtgccctacagtttgagaaccatggaagcttagcatgatggctgacagcatgggctccagggccataatgcccagattcaaagccttatttcaccattcaccaactgtgggaccttaggtaggtgacttaatgtttctctatatctcagtttacctatctgtaaaatgaagatagcaatatttacctataataataatttaacattatatattgcttaatacataaatttaattatgcattataatgtattaatagatataatagtttccacacataatgggtggcaagcacttggcacgggcctcagaacaccagcatacccactaatta

SEQ ID NO: 378847 - DNA, 1293 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagccagcctagcaccattgccaccagcatgcgggattccctcattgcagcctcacctgagtcaccttccaagttgttccatgggctcctggctctggactgtggccaaccttctccacattccgcccaatctgtaccggatgctgaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378848 - DNA, 1661 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggtgaggcagcccaacttgacccaagagtcacagggccatcctagtcagtggttagccactgttctttcccaacaggcagcaattaggggtctctcctgtggtttttctatatgggctcttgagtttcaggtactcattggaatagtgataacagaggccttatcaagtgtcagaaagaagctggggagggtatgaatccttcatgattggggagattgaaccatccagtcctgcatcctgggccaggataggtgattgactgttgaacttttgactgtgggtgagaggggaaagaagtgatattgagaccagcctccagctgttcagggcatgcatgaatattaggggcttcacagctgcccttgactctgctctaagctgtacttcctcctttctctgggtgaggctttcatatgaggtacagaggagaaatgaggggctcagggagccaaggcctggatgcttctgggcatggagaaccttggttctggggctgtaagttctgagccctgaacacaatatctttgattgacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378849 - DNA, 1066 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttgagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378850 - DNA, 1032 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacgacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378851 - DNA, 1033 bp, Homo sapiens
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccggg

SEQ ID NO: 378852 - DNA, 1077 bp, Homo sapiens
tggctagtagaggctggcggtgaaatcggcaccgaggctcgtgccgggatcctgggagggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtgggcaaaccttctccaattccggccaaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378853 - DNA, 1169 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacgacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtgggcaaaccttctccaattccggccaaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccggaaaaaaaaaaaaaaaaaaactgggttttgggggggaaaggggtaaagggggtagtttcggcgcctttgtgaagggacgggccatggggtatcgaggaggtgtggaggagggaaaaaaaaaggaaagagatagggacgg

SEQ ID NO: 378854 - DNA, 455 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcgctccttgtcgtgcgattggggatcctaaagagcgaccccagcaac

SEQ ID NO: 378855 - DNA, 587 bp, Homo sapiens
gacggccagtactcctacggtttaaggtacgaggctgggtggcggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtggcaccccattaaagtgcagttcctccgg

SEQ ID NO: 378856 - DNA, 242 bp, Homo sapiens
aaccatatacattttaaaaattgtgataatctcctataggaacagattgttttaactacatgaattattttaaaaagtcgaggtggcaaaaaagtacttcaacgaggaataatctctttgggaaaaaaacacaagaaaaacatatgacagatgatgtgccaatcagctcaatatgttaagagttcatacaaattaagaacttgacagaaacaagggcaaaggataccaactgtttattaaaa

SEQ ID NO: 378857 - DNA, 333 bp, Homo sapiens
agctggatgtggtggcaggtacctgtaatcccagctacttgggaggctgaggcacgagaattgcttcaacccaggaggcagaggttgcaatgagctgagattgcctcactgcactccagcctgagtgacagggcaagactccacctcaaacaaaccaaccaaaaaaacccacaaatctgtaaagaaggattacagtcagttttccactttatacctgatttaattctataatgcttgagtatttaacaaaaaatggttattacttttataatctagaataaatttttcaattttgcaaattaaaaatattgtaaatgatcatgtagagctaca

SEQ ID NO: 378858 - DNA, 509 bp, Homo sapiens
gcaaaaataaattcacattagaaaagatgcagctaatgatattaaaaaacaagtatttctccagtgtctggagttgaactgaaaagaatacatgtatatctataatacatcctgaaagtattcctttaaagtcttatataaacaggttcttcaaacaaaatattatcttaatgccaatagaacagatactttgtttccatgatgcatgatgagatagctcaaataagctaaaatgtatacaaaataaggttaatttatttttatttattttttaaaatttatggaatgcttcacaaatttgcatgtcatctttgtgtaggggccatgctaatcttctctgtatcattccaattttagtgtaagtgctgccaaagcgagcacaaaataagctgaactgataaactagtaaagatattttcctcttaaacagcagccaagagggcaaatgcatcaggagactgaaataaggcgatttttttaagtccaacttttactttaattgttttctt

SEQ ID NO: 378859 - DNA, 212 bp, Homo sapiens
atcgcttgaacccaggaggcagagggtgcagtggaggttcaagaatcgcttgaacccaggaggtggagattgcaccactgcactccagcctgggcaacagaacaagactccatctcaaaaaaaaaaaaaaaaaaaaaaaaaggactttctagcctacaacttcacccccaaagtgcacatgggggcaacaaccgaagccactggccaacgag

SEQ ID NO: 378860 - DNA, 383 bp, Homo sapiens
gtgcttcttccttctgggaggtttctagacttctggaatgagaggtcccctgagggtgcattgccagacatttctctgcatctttaaaaccagagtttttatttgttatgtttttttcttgagtgcctagaggatctaagagtttagccagtatcatataacctctcaactcttctgatgttggaccttttctctgaaacaaactcaaagacaagcaagcaaattagatgactacagcatacaaaacataaaggctggacctaaatgggtcaatagcaccatctcttggccatgtgtgagtactgcatctaccagttttcaactagtgaaagtacaaaacacacctgtggatttgcggttaactaaagcagagtaaaaatatc

SEQ ID NO: 378861 - DNA, 1263 bp, Homo sapiens
  misc_feature (3)..(3): n is a, c, g, or t
  misc_feature (86)..(86): n is a, c, g, or t
  misc_feature (262)..(263): n is a, c, g, or t
atnccattctctgtctcatggggcgtcctcctgctggcaggcctgtgctgcctggtccccagctccctggttgaggatccccaggnagatgctgcccaaaagacggatacatcccaccatgatcaaggggactgggaggaccttgcttgccagaagatctcctataacgtcaccgacctcgcctttgatttgtacaagagctggctgatctatcacaaccagcatgtcttagtcaccccaacaagcgtggctatggcctttnnaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtctatcaatctacattttcccaaactgtccatttctggaacctacaaactcaagagagtccctaggaatctgggcatcaccaagatcttcagcaacgaggccgacctctctggagtcagtcaggaggcacccctgaagctctccaaggctgtgcatgtggctgtgctcaccattgatgagaaagggaccgaagccaccggagccccccatctggaggagaaggcctggtctaagtatcagacagtcatgttcaaccgacccttcctggtcatcatcaaggagtacatcaccaactttccgctcttcattggaaaagtggtgaatcccacccaaaaataa

SEQ ID NO: 378862 - DNA, 679 bp, Homo sapiens
cccacgcgtccgctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggagctggaagctatcaaagctcgagtcagggagatggaggaagaagctgagaagctaaaggagctacagaa

SEQ ID NO: 378863 - DNA, 2395 bp, Homo sapiens
cccacgcgtccgctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagttgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaa

SEQ ID NO: 378864 - DNA, 1601 bp, Homo sapiens
tgctgcatagttgaatgcctgcgtggatgccctttcacgagactgtgagtttttgtgtttctcgcagccagactatgaaatagtactgtgagtttcagtgtcctgtgttcttttcccatcactccttgtatttggtagaaacaggtattttgtgtatattctcagaggcaagtgatagaatggccttggggcgtacggggatccccgtacgcccaaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaa

SEQ ID NO: 378865 - DNA, 220 bp, Homo sapiens
aataaagcccagaagtttaatgagaaggactgaacagggtttgtgacttctacactgtatagcctggggtcaggacatttccttgatccaatcatctcttcatgaccttgttaaaggcaagaattagaataacagggatttgagaaagtgttgggatcattaagaaaaaaagagtctttcccccatcctcaccccactcctataccagccaaatggtcaa

SEQ ID NO: 378866 - DNA, 308 bp, Homo sapiens
aggagtggatggtggcctacctggagacgcggctggctgactggatccacagcagtgggggctgggtaagaagcttctcaattgccgctctgcacatccttctgcaaagctggtctccagggggaagatgggggctctgattggaggctgaggcagctatgttgggaatgaggtacggggctgagtctccccgtctggatggaattagattgagagatgcctggactctgcactccagggctgccatgcagtcaacactggatgggctcatggtcccaagcagaggacagaatacacacccaaggagt

SEQ ID NO: 378867 - DNA, 3544 bp, Homo sapiens
cccacgcgtccgctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaa

SEQ ID NO: 378868 - DNA, 3516 bp, Homo sapiens
cccgcctgacccggctccacgctggctttcatcctcctggcagcgtggagccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaa

SEQ ID NO: 378869 - DNA, 2855 bp, Homo sapiens
cccacgcgtccgctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtggtgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcagcttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacttgcatccagaggacacttggcatccagaggacactttgcatccagag

SEQ ID NO: 378870 - DNA, 957 bp, Homo sapiens
actctgaggatcccccgatccgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaccagacataagacagcgacgttaaactcttggaatccggtcacatgcaaacattagtctgtcattaccctgatcaccccggcagttttacttctgaccaggcccttgggacacgctcagaggaaattcccacacagacccatatt

SEQ ID NO: 378871 - DNA, 1064 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378872 - DNA, 1095 bp, Homo sapiens
tccccagagacacgccatacgatcggagacactcccggacgcctagcacgcacaggggccagttcgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378873 - DNA, 1117 bp, Homo sapiens
  misc_feature (1093)..(1093): n is a, c, g, or t
  misc_feature (1100)..(1100): n is a, c, g, or t
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaaaaaactggcgcgtttacacgcgtgactgncctgggntcccactttcgcttgag

SEQ ID NO: 378874 - DNA, 970 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaccagacataagacagcgacgttaaactcttggaatccggtcacatgcaaacattagtctgtcattaccctgatcaccccggcagttttacttctgaccaggcccttgggacacgctcagaggaaattcccacacagacccatatt

SEQ ID NO: 378875 - DNA, 908 bp, Homo sapiens
  misc_feature (892)..(892): n is a, c, g, or t
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaactttgttctcaattattacttgtaaaccaaggcctcttatttatcttttttgaccgaaggtctcactgntaggcaaaccgtacct

SEQ ID NO: 378876 - DNA, 1054 bp, Homo sapiens
tatgaatcgacggttctcaccaagaagtatgtgttctggtggctaagataatgatttctgtcctggcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378877 - DNA, 977 bp, Homo sapiens
  misc_feature (665)..(665): n is a, c, g, or t
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttactnaggcctggtatgtttgggtggcctccagtggcgcgcggtgcggacacatcctgttctgtgagagattccccttgtccatagtgctggcctcagtcttttttttccccgacgtattggctcctgtttccagaccagcaccccttaattctgctccttgcctcggcgactccgtcgctctctttgtgaccggcagcttacttggcgcgcaggggggtgtgcgggcgtcccaccatgtccttccggctcttggttgcgcaaaaaagcgtgcttctcggctgggtcgtttcccgctgtcgcctggtacgtcgcgta

SEQ ID NO: 378878 - DNA, 892 bp, Homo sapiens
  misc_feature (664)..(664): n is a, c, g, or t
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttggnggggagacagtttggctcttgtctcccgggtgggagtgcgggggaatgatctcaattctcaactcatggaaacctcggcctccgggatattcttgcctcagcctcgggggtagctggaataaaaagcaccaaaccacgcccagttattttgggtatctcgggaagagaggggagtacaccatgtgggccaggctagtctcgaattcatgacctcaattgatccgccca

SEQ ID NO: 378879 - DNA, 1028 bp, Homo sapiens
cgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378880 - DNA, 1022 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378881 - DNA, 1009 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagtctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378882 - DNA, 742 bp, Homo sapiens
tgtgcaagccgggcgagtcgcgacgtgtatcctccatttccaaccaatcaatgaaacagacacacctgcagagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378883 - DNA, 1051 bp, Homo sapiens
actctgaggatcccccgatccgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378884 - DNA, 1488 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaaaaaatgagctgttttctttattctgagaaatattaaatagaaaattgaggcttagaaaaaacataaataggcctgcttagaagtaacatttcaagaaggaaataaagctacttggtgtttctgacagactgatactgatgccaaacaaagaataacagttttataaatatcaccttgttccaaaagtttctctaggtcccatgttaatatgcaagtatactagcagaaaaattgggccatagtatcgtggatttccaggtattttctgtatattaagtgaggcacggagcatagggtatagggtagcacatgtggcaaggaaaaagttctgattttgcctttgttgctgataaaacactgaaccattctagcctgcacttatcataagtaaatactccctaacctaaaataaagttttcgttcc

SEQ ID NO: 378885 - DNA, 992 bp, Homo sapiens
cgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaa

SEQ ID NO: 378886 - DNA, 907 bp, Homo sapiens
gtgtccaatcttttggcttccctggtctactttggaagaattgtcttgggccacctataaaatacactaacactaaaggtagcggatgcgctaaaaaaaacgaatcacaaaaaaaatctcataatgttataagaaagtgtacaaatttgggttgggctgcattcaaagccgtcctgccacatgcagcccatgggccgcgggttggatgagcttgctgtagattaaagagaaaataagaagtgctgaagcagagaagtcatagagtagatgctagtcatttagggcgaagttagtagttgaagtttatttgttggctcatgtcagtagtggagaagaagagaaagaaagacttaaggaatggcataatggatggagcaaggcctaggacagtctatcaaattgttttactggttgtcacacactgttagatttaatccttctaaagatcatgtgagctaagtatccatagtttacagatgagataactgagactcatgaaaggtttagtaacttgccatggccacgcaagagagtaaagtggtagaactgagattcaaactgcacagtatttataccacactgtacgtcatatactttattgacagactagattttaaagaaaaaattagcttgaagtggtagattgacacatagaactgatagctgttttgaagaactgcaagttttggtaaagttaaagagcttgtagagtgtaagtgggaaaaatggaaagacaaagagattttgatcatagaacaatggctccagagtgatgacatgtgagggaagattaaagtagaaacagggatgaaggttattggagaagccaggatctgctaaaatgttttttttaaaaaagagtgaacagtatggatgtttggatagctagggtggtatcaggagttga

SEQ ID NO: 378887 - DNA, 342 bp, Homo sapiens
ccaaagtgctgggattacaggtgtgagtcattgtgtctggcctaaaaaagacatttttatcatcgtgcctcacctaaaaaagccattcttattagtgctaattttatctccctcaacatatttgtagaatcttagaaacagaaacagtgtcttctattttttggtgtccctatggcacctaaaatatttacatatcttcattgcaaaatgacttaatagcaaaataaagacatacatgctattatatatgcaaatatacattagtataaataaaagtcatggactcctaattttgagacagattaacatagctaaactgaaaagttcattatgcattttcag

SEQ ID NO: 378888 - DNA, 449 bp, Homo sapiens
agattttctcacttgtattacttttatatctctcttagctttgaaagtctatggggaaggcaactttactctccatttaagttggacacagtaaacaatggagggatataaagaatttaaatggaggaggatgggttgcctgagaagtcagacttgtgtatggaattgcaactgactgacaggcatggaagtgaggtgtggcagtggcatgagctctttttggagatttataaggattctgctgtagcatcttcctccgtggatgggatctatttctatgtcctttgatagcagcactagcttggacattcagagggagatgtactagagaatatggagatcacatatgagattccttcatcatcagcctcttgcctctgtcctttgctctgcaagtgtttccttcctgtagtctgaggaataccggtaatgtagggagaaaaaaaaaa

SEQ ID NO: 378889 - DNA, 5200 bp, Homo sapiens
  misc_feature (1930)..(1930): n is a, c, g, or t
  misc_feature (2667)..(2667): n is a, c, g, or t
  misc_feature (4032)..(4032): n is a, c, g, or t
  misc_feature (4246)..(4246): n is a, c, g, or t
  misc_feature (4652)..(4652): n is a, c, g, or t
  misc_feature (4881)..(4881): n is a, c, g, or t
gcctccgacccgggccgactatggcggcgctgcggctcctggcgtcagtgctcgggcgcggggtccccgccggcggctcagggctcgcgctgtcccagggctgcgcccgctgctttgccaccagtccccggccccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtgggggcttccccccagaagacatccacgttcctaacatttatgtaggtcgcgtgataaaggggcagaaatacgagaaacgaattgagcgcttaacgatccggaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagggctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcggatgccaccgggttccccaggggaatacatgtccccagctctgggaggggtttgctactggcctcctactttcctccctaggtggacagtgctcctctagagagctgcgactttaattaaaaacaacaggaaaacagatcagttcctcactgtgtttctcgagcactgcaaggcgcaggtctgcagtggtgaggaatggatgtccgctttgctctgtgatgtttacacagagcgtgcacagctcagcgcattcacagcaagatttgattcaagcgcctccctcgtacttgaaccatgaaatggagataaaaactgacgagggagaaaatcactnaacccagagtacacctgaagggacattttactactgcagtgagaaataggcgagcaaagatgtgagtttgtgattggaagacatgctatcttcatgagcttgttttttctttttccttctctttcttttttctttttttttgaggcagggtctggctctgtcactcaggctggaatgcaatggaatgcagtgatctcactgcaacctctgcctcctgggctcaagcaatcctaactcagcctcctgagtagctgggactacaggcgcacatcacaatgcctgcttatttttttttattttttaaatttatttatagaaatggagtttcaccatgttgcccaggctggtcttgaacacttgagctcaagcgatccacttgcctcagcctcccaaagtgctgggattacagacatgagccactgagttgggccaattaaccttagcttactgtaatttttttttcttttttagacagaatctcactctgttatctaggctagagtacagtggtccagtctcagctcactgcaacccctgcttcctgggttcaagcaattctcatgtctcagcctctcaagtagctgggattacaggcatgtgccaccatgcctagctaatttttgtatatatatttttaacagtagagatagggtttctccatattggccaggctggtctcaaactctgggcctcaggtgatccacctgccttggcctcccaaagtacaggcttgagcnattgcacccggccttcttgaacgtttttatccgttatctggtatttcttctggggcctttgttgttaaattttgtttccctgaagcctcccctcctcctcccacatctctcctcctgggacctatgagatgttaagcttctagatgtccgtagaaggaaagcaggaccatctccaagggaagggaccgggtgatgggagagactgagaggggagaggctgccggtcctgaaatccaccaggaagcttcctctatctgtgtgtggccaaaggctacagcctaggacaggaggagttctagaaccctaaccaagggactagatgagttttctcagcttcatttgaattgttcctgcatcattcacaccagacacttaggccctcctctctgggatggaggcccaaactggccacttgtgtgatggtccgttgtaacccaagaggctgcgaggcatttcctcctgaatctatagtctcaaaaactaaaattaagattgtgtgtgtgtgtgtgtgcgcatgcacgcgtgcacacgtgctgttgacagccaagcctggcctggtgcatgcactgcataagtgtagctctgggggttcccaggccattgggggcatgtggtcagagtagtaagttctcactggtcaaggacagactttccaggggcccattggagcctcaccctgcaggaaaggccagatcctgggaaggagagcagggcagggagagttggcgctcatggagggcacagactgggggtgtggaaaaggggccagggactatggctggggttgggggcttgaaatgaaatgtcatctagtgggcagtggggtgccttttggggctcctggagaggggcacctgatttgccctgggcgtcagtttcccaggagcagtgtggaaaaggctgaggtatctagaagcggacaagtgaccctctgggcctccaactccacctttctggaaggggcctgcccacagctgggcagcctgagagccccccaccttgactgcttggccttccctgcagccagctggagccagggagtcctgcctaagaatgggtgggtaagaagcagagctgatggagaagggaggctctgggctctggaaggagagggctggggatgggggagcttctccaggcctgccagatgcagggctctgaacccagacccactgttagtccccttcaccaccccccatcttgcccagccacatccagctgggccctgcagtttgctggaaaagtatatgacaatcctggctccgacccaccttgctctgggaccttggacagttgctgctctctctgggccttagtttctgcttctgtaaaatgggaacctgggattagctgcttccaaggttncaaggctcgcctggcctgtgagacctacagaggggttcccagcacccaagccaggcctggctcagaggggctctgtgagggtctgtggtgtaactgatctaatgcgacattctatcctgtgtctgggagaccccccataagacccttgaacacagctgcacagaagcaaatagtgaggaaagcctgcaggactgatggcctctcaggccccatngcaggcagggctccccagggagtcacaggacagagctgcaagtggagccaggagggctgccctgggccccaggctgtccccatgggtcagccagtctgcagagtgacactccagtgcccgggctggtgaccaccaccaccccactcaggctgctctgttctctctccgttgtgacctcacttgtcttttcctctgtgccccagctctgttccttgtatttctgctgcttccccataaccttgactcaccgtgactcaagccctgcccagtggattctctctgggcctccttcccatgttagcatctgcagctcacagcctccctgtctcagcagctcttgtccatgctcgtgagagggagggagcctctcctgccagtgcatttgtttgtggcggatgatgtcacnggtcaaaggttggtctctggattcactggttgttcagtcaagtggccaagggacaccagggctgaggcacagctgcttaagggctgacctttgagtgggactgagggtggggcaggcagtgtccttgacctgtagggtgtactggagaactacgtaggaataaatacatctgtgtgtgtgatgtctgtctgagcgtatgtgcatctgtgtgtttatgcaaacatatgcntgtgtgtacatacgtgtgtacatctgtgcttataacatggaggtgaaatgtactttcgtgtaaactgaacaactggcactgtttaaagagacatgaaaatgagctggtaatcatgcttctgcaattcagtatcaggaaatttcacccatgcacggagtgaagaggctccattgcactcccatctttatcatgaaagccgggaaataacctacatgtctatgatgagccaatatcaagtcaattacggtatactgctccaagggattttataaatttgaaatgtttattgtggagacttatttaaacaaccagaaaaagt

SEQ ID NO: 378890 - DNA, 291 bp, Homo sapiens
gatcctcctgccttggcctcccaaagtgctgggattaccggcaggagccactgtgcctggccagttcttgttcagctacaatttattttcctattgctttttggaatgtaatttaaactttacacttcagttatcccacttgtcaaatgcatacatgatttcgtggccaataacctgtacgtggacacagtaaagttaaaacaataaagatgcacggaattttgatgctgataggtatcataaaataatgtgatccaaactaaggagatatctgagctcagagacagtaaa

SEQ ID NO: 378891 - DNA, 182 bp, Homo sapiens
tttccagatgcatacagtgatcctcaaagttatgtagagcctcatcagtatgtggtttgcaaagagcagtcacggtttctaccatttccttatacttagtgggatttgtgggctttgaatggtcacaataatcaaatgaagttcttaactgccagaaagaaagcatacgggtccagaaaatt

SEQ ID NO: 378892 - DNA, 366 bp, Homo sapiens
gcgcctgtatcccagctacttgggaggctgacgaaagagaattgcttgaacccaggaggcggaggttgcagcgagcctagatcgcaccactgcattccagcctgggcgacagagctagactctttctctaaataaataaataaataaatacataagtaagtaaataaataaagctttaaagtgctatgtttaaagcatatatattttttttaagtcactgagctgttgaaaaactaaataatcctcagagccaacaagcaagagagagctggacccacagaggaaggtgaaagtcaaaaacggcctccaccccatggctggaccagaaagaggccctgtctgttttcttccacctgtgttattgga

SEQ ID NO: 378893 - DNA, 1153 bp, Homo sapiens
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggccaaggagcagtgaggacgcttcctctgtcctgaccgcgcctcgtccaggctgctcccagaatagttttgctgtctccttcctgcctggcaagaatgtctttactatcatctccttccttttctccgggacagcctgtttaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgtaagaactctgcctatgcttgctaaatacagatcgaattaatggtttactaaaataaaaggaagaggggatcttggggacatcgtattttaatgcagttgtcaagccagttagcatttgttgactacccaatgggtgcctaaggctgtacaagactcttacagggaatttgcagaccccagagatcaggatgggcaacatggaggccagtatcaagctgtggggaggccactgccctgagaaacacatattctaattactcttgtcctgtaacctttctgggacgtagttttctcatctgtaacaatgggtgtattatttaccacttcgtctgcagccactaatgatttactttttaagttcttctagggaaaataaac

SEQ ID NO: 378894 - DNA, 756 bp, Homo sapiens
attttcccgctgcgaatcaaatgttgcggagggatttgaatatgaggcgcgcagctttatgttttactgctgcatatccaacacaatcctccattccttttaaatctcaagcttcagtaatcccagaatcagaaaaaaaaggattcaatagtcaagccaagagatttcctcataagaaggtaatgacgttgtctcaggggttctttcgttttagtctggattttagccttgcgggacaggcacgttctgtctggctgctgtgtctttctgtggacagtggagggcagtgtgctcccaggagccgcggcaccagctccactgaggggcaccgactggactaactgtaagaacgagcctgaaaaatgggacatccagggaaaaacaactgtgtctggatttatggcgccaaaaatattgaactggaccaaaactattttaagaaaacaatatattttaaaaatcatcataaagctaaaaaattgcaaaaattcccaagtgttatcaattaagtaaaagattaaaaaaaaatcttccccatccttgtgagaggaaatcacatgacttcaaataacacaagaggaaaagaagagtcgaatacatctagaattacctttggagggccgggcacggtggcttatgcctgtaatcccagcactttgggaagctgaggtgggagaattaattgcttgagccaggagtttcagatcagcccaggcaacatagcaaaacccaatctctacaagaaaagaaaagaaa

SEQ ID NO: 378895 - DNA, 2979 bp, Homo sapiens
tcaccaagtattcaaatccaaaacgtccttgaagacccagcgctccccagagccctcgcgagacttgggaccaaacatatctctcctttcctgccctcctggaacacctgtcggataccaagcctcccagcaatactgaaggtcctgaaacgagcccagcgcttggttaatgtttctataatgtacataattatcacggccatgataattaacatgcgcatggagttttacagatgacaagcttctcatcgctcacacgttgtcatatacacgcatttgctttcagatcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378896 - DNA, 3098 bp, Homo sapiens
tcaccaagtattcaaatccaaaacgtccttgaagacccagcgctccccagagccctcgcgagacttgggaccaaacatatctctcctttcctgccctcctggaacacctgtcggataccaagcctcccagcaatactgaaggtcctgaaacgagcccagcgcttggttaatgtttctataatgtacataattatcacggccatgataattaacatgcgcatggagttttacagatgacaagcttctcatcgctcacacgttgtcatatacacgcatttgctttcagatcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378897 - DNA, 2867 bp, Homo sapiens
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggccaaggagcagtgaggacgcttcctctgtcctgaccgcgcctcgtccaggctgctcccagaatagttttgctgtctccttcctgcctggcaagaatgtctttactatcatctccttccttttctccgggacagcctgtttaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378898 - DNA, 2301 bp, Homo sapiens
  misc_feature (2140)..(2140): n is a, c, g, or t
accaatgtggaagagaaatgagacttactttgagttggttccaagggtgggaattaggacggatagaaaaagaaaaaaagagagagagaatcagctttgatacaggaaggaactttctagcaattagaactgtccaacagtgaacttcccccaggagtttttaaactgtgttctgatgaaacctagcattctgtgaatattcaagagagtcaaatatttgcccccacccagccatcccttatttgctttatattttgaaaactatatgcaatattgtaacttcagaaacccaaccaggtaaggcacggtggctcactgtaatcccagtgctttgggaagctgaggtgagaagatcacttgaggctaggatttcgagaccatcctgggcagcatagattctaggtccatgccatcctgtcatggacagttatacaggtggaccagtgaggcacacctgggcagtgctctgttcacatctgtcctgcacctgctctcatcctgccttcacaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatggtgagaaccacttctcttgagtaaagcattaactgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgtgagtcccaatcattctggtctttcttttgaaaggtggttgtggggaagaagcccaacatagagaaaaggatggggtgtcactgcttggcagagcacagtgccgggccactctcttcaggggcccttagtcacacataatgatgctcagtaaatgcctgttgaatgcctgatacttattgagcaaccactgtgtgccaggaacttaaaattgtattcaattattattataatcctgttgtaagaattgttactcttaccccatagaggaggaagcaaggcttcggatttggcgggacatttgcccaagtccacacagccaacttgaggagccacagggaattggctcaggactaagtctttcctcattccctgtgatgctggattcccctggtgctgacattgttctatttttgtaacataaaatcttcgctggagtggcaggacattcagaagcagtcaagctctcatagctttataccgatggaagtttaagccctgactttcgagttggtgatacctgctggatttgtacttcagctctgctgtttttatgctctgtgaccttgggcagagttctaacctctctgagcctccatgccctcatctgtaaggtgggaataattcctgcctcgtaggattttgctttcagaattaaaaatacatgtttggctgggcgcagcagcttgcgcctgtaatcccagcactttgggaggccgaggtgggcgaatcacttgagatcaggtgttcgagaccagtctggccaacatggtgaaaccctgtctctactnaaaatacaaaaattatccaggcatgatggtgcacgcctgtaatcctagctactcgggaggctgaggcaggagaatcacttggacctgtgaggcccagattgtggtgagccgagattgcgccactgcactccagcctgggtgacagagtgagaccctgtctc

SEQ ID NO: 378899 - DNA, 1131 bp, Homo sapiens
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccaggtcagaggattgttttaaatgattgtaaaaaccaaa

SEQ ID NO: 378900 - DNA, 1452 bp, Homo sapiens
tcaccaagtattcaaatccaaaacgtccttgaagacccagcgctccccagagccctcgcgagacttgggaccaaacatatctctcctttcctgccctcctggaacacctgtcggataccaagcctcccagcaatactgaaggtcctgaaacgagcccagcgcttggttaatgtttctataatgtacataattatcacggccatgataattaacatgcgcatggagttttacagatgacaagcttctcatcgctcacacgttgtcatatacacgcatttgctttcagatcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggccaaggagcagtgaggacgcttcctctgtcctgaccgcgcctcgtccaggctgctcccagaatagttttgctgtctccttcctgcctggcaagaatgtctttactatcatctccttccttttctccgggacagcctgtttaaggttttactgctgcatatccaacacaatcctccattccttttaaatctcaagcttcagtaatcccagaatcagaaaaaaaaggattcaatagtcaagccaagagatttcctcataagaaggtaatgacgttgtctcaggggttctttcgttttagtctggattttagccttgcgggacaggcacgttctgtctggctgctgtgtctttctgtggacagtggagggcagtgtgctcccaggagccgcggcaccagctccactgaggggcaccgactggactaactgtaagaacgagcctgaaaaatgggacatccagggaaaaacaactgtgtctggatttatggcgccaaaaatattgaactggaccaaaactattttaagaaaacaatatattttaaaaatcatcataaagctaaaaaattgcaaaaattcccaagtgttatcaattaagtaaaagattaaaaaaaaatcttccccatccttgtgagaggaaatcacatgacttcaaataacacaagaggaaaagaagagtcgaatacatctagaattacctttggagggccgggcacggtggcttatgcctgtaatcccagcactttgggaagctgaggtgggagaattaattgcttgagccaggagtttcagatcagcccaggcaacatagcaaaacccaatctctacaagaaaagaaaagaaa

SEQ ID NO: 378901 - DNA, 895 bp, Homo sapiens
accaatgtggaagagaaatgagacttactttgagttggttccaagggtgggaattaggacggatagaaaaagaaaaaaagagagagagaatcagctttgatacaggaaggaactttctagcaattagaactgtccaacagtgaacttcccccaggagtttttaaactgtgttctgatgaaacctagcattctgtgaatattcaagagagtcaaatatttgcccccacccagccatcccttatttgctttatattttgaaaactatatgcaatattgtaacttcagaaacccaaccaggtaaggcacggtggctcactgtaatcccagtgctttgggaagctgaggtgagaagatcacttgaggctaggatttcgagaccatcctgggcagcatagattctaggtccatgccatcctgtcatggacagttatacaggtggaccagtgaggcacacctgggcagtgctctgttcacatctgtcctgcacctgctctcatcctgccttcacaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggtacatgtgtctttgcagggaggagatagctcctgacatatgcttattttagtacataagagcaaatttggggggaatagtaagtcctgggttatatccacagggccatccttacaggcataccaaataggtggctttaggccctactgtttcaagtgtgacgattgggaagaaactgagaagaaaggatgagagaagaaggaggaagtctgttaaaaaataaaaaactaataaacaaaacccagac

SEQ ID NO: 378902 - DNA, 985 bp, Homo sapiens
ccatgtcacttcctggtttggtagagcctggcatcacctttagtaaggtagcccatgcccccgctcctcttggcctcgatgcaaaactggaaagaacattccaaggcaacgggacccaggttggcgaggctggtgacagtaagaaggaagggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaaggtaatgacgttgtctcaggggttctttcgttttagtctggattttagccttgcgggacaggcacgttctgtctggctgctgtgtctttctgtggacagtggagggcagtgtgctcccaggagccgcggcaccagctccactgaggggcaccgactggactaactgtaagaacgagcctgaaaaatgggacatccagggaaaaacaactgtgtctggatttatggcgccaaaaatattgaactggaccaaaactattttaagaaaacaatatattttaaaaatcatcataaagctaaaaaattgcaaaaattcccaagtgttatcaattaagtaaaagattaaaaaaaaatcttccccatccttgtgagaggaaatcacatgacttcaaataacacaagaggaaaagaagagtcgaatacatctagaattacctttggagggccgggcacggtggcttatgcctgtaatcccagcactttgggaagctgaggtgggagaattaattgcttgagccaggagtttcagatcagcccaggcaacatagcaaaacccaatctctacaagaaaagaaaagaaa

SEQ ID NO: 378903 - DNA, 2723 bp, Homo sapiens
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378904 - DNA, 2604 bp, Homo sapiens
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378905 - DNA, 3134 bp, Homo sapiens
accaatgtggaagagaaatgagacttactttgagttggttccaagggtgggaattaggacggatagaaaaagaaaaaaagagagagagaatcagctttgatacaggaaggaactttctagcaattagaactgtccaacagtgaacttcccccaggagtttttaaactgtgttctgatgaaacctagcattctgtgaatattcaagagagtcaaatatttgcccccacccagccatcccttatttgctttatattttgaaaactatatgcaatattgtaacttcagaaacccaaccaggtaaggcacggtggctcactgtaatcccagtgctttgggaagctgaggtgagaagatcacttgaggctaggatttcgagaccatcctgggcagcatagattctaggtccatgccatcctgtcatggacagttatacaggtggaccagtgaggcacacctgggcagtgctctgttcacatctgtcctgcacctgctctcatcctgccttcacaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattgaaaaaaaa

SEQ ID NO: 378906 - DNA, 1470 bp, Homo sapiens
  misc_feature (1309)..(1309): n is a, c, g, or t
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccaggaggaagcaaggcttcggatttggcgggacatttgcccaagtccacacagccaacttgaggagccacagggaattggctcaggactaagtctttcctcattccctgtgatgctggattcccctggtgctgacattgttctatttttgtaacataaaatcttcgctggagtggcaggacattcagaagcagtcaagctctcatagctttataccgatggaagtttaagccctgactttcgagttggtgatacctgctggatttgtacttcagctctgctgtttttatgctctgtgaccttgggcagagttctaacctctctgagcctccatgccctcatctgtaaggtgggaataattcctgcctcgtaggattttgctttcagaattaaaaatacatgtttggctgggcgcagcagcttgcgcctgtaatcccagcactttgggaggccgaggtgggcgaatcacttgagatcaggtgttcgagaccagtctggccaacatggtgaaaccctgtctctactnaaaatacaaaaattatccaggcatgatggtgcacgcctgtaatcctagctactcgggaggctgaggcaggagaatcacttggacctgtgaggcccagattgtggtgagccgagattgcgccactgcactccagcctgggtgacagagtgagaccctgtctc

SEQ ID NO: 378907 - DNA, 1260 bp, Homo sapiens
tcaccaagtattcaaatccaaaacgtccttgaagacccagcgctccccagagccctcgcgagacttgggaccaaacatatctctcctttcctgccctcctggaacacctgtcggataccaagcctcccagcaatactgaaggtcctgaaacgagcccagcgcttggttaatgtttctataatgtacataattatcacggccatgataattaacatgcgcatggagttttacagatgacaagcttctcatcgctcacacgttgtcatatacacgcatttgctttcagatcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctc

SEQ ID NO: 378908 - DNA, 633 bp, Homo sapiens
ccccttggcagagctccccttcgagagctccccttgtcgagctccccttgcgagctccccttggcctcccaaagtgctgggattacaggcatgagccaccacgcccaggctttttaaaaaatcatttgtttctaagtgtttcattattttttctgcctctgtctcttgactgactaggacgacagatatttgccaccacatctggctaattttaaatttttttgaagagaaaaaaattttgctcaggctggcctctaactcctggccttaagcaatcctcccaccttggcctcccaaagtactggaattacaggcatgggacactgcatccagcctgagttttaacaaatgtatgcacccatgtagatgctaccacagtcaagatatatttcagtcacccccccaaaggtttccttgtgcccctttgcaggaacctgggactgactgcactgggtggttctgcctcagtgtctctcatgaggttgcagtcaagcttttgcctgggactgtgcagtctctgaagacttgactagaactgaaggatctgcctgttggtaggtggcttcacttcctagtcatgcttctccatagagagaaaaagagtgaagccaccatgccttttatttatttatt

SEQ ID NO: 378909 - DNA, 308 bp, Homo sapiens
ctctgagagaaggcagcatccatgtcttgaggacactcaggcagcctgggacaggcttggggagtgaggagctgggaccccagccaacagtcatgctggacttgctccaggacacatcaccttggggtttgctcttcccaggtcagtaggcatccagcgctggggcagctgcttcaggacatcgccgaggacaagtctcctccccattctggttccaccatctgtagcctgtggctttcatcctcaagggctccatgcgaccgctgcacatccaggctggctgctggcgggatggacacgaatgttca

SEQ ID NO: 378910 - DNA, 2316 bp, Homo sapiens
tagagggcgggcctgagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378911 - DNA, 2315 bp, Homo sapiens
ctacgccgacggccatgcggctcggcccgcacattccgtgacaccgaaaggggccccagcatatttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378912 - DNA, 2229 bp, Homo sapiens
ggctggtacggcccgggagttagggatgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378913 - DNA, 2166 bp, Homo sapiens
agcggggccgcggcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagtgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378914 - DNA, 2208 bp, Homo sapiens
ccaggggacccgacgacacttgctggctgcgtgacctcggtcacaccagggccattttgctgacaagacaacagaggccgggcgcggtggctcacgcctgtaatcccagcactttgggaagccgaggtcagtaggcatccagcgctggggcagctgcttcaggacatcgccgaggacaagtctcctccccattctggttccaccatctgtagcctgtggctttcatcctcaagggctccatgcgaccgctgcacatccagtgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378915 - DNA, 308 bp, Homo sapiens
ctaggaggccccgcgctgacccgccttctccgcagctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacc

SEQ ID NO: 378916 - DNA, 497 bp, Homo sapiens
gttgaagcctcatgatttatgtccattcttcctccacacggtgtccacacacccatttcaccatgaggaagcaggcacagatgccccccgcctgagctcacacagccagggggaggagggctggggtttccaaaacaagtctagatgggctctggggtccagctcacaggcccactcagagtgggtgtcaggcgactgttggtcaattccttccttatctggtggccccatcagcctggagaggaaggctcttcctgaatcactcagtgaggcttccatgcccctcttttccttttatcagctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcatctcgactctgccggcggggtggcctacctggatgacatc

SEQ ID NO: 378917 - DNA, 1441 bp, Homo sapiens
tagagggcgggcctgagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcatctcgactctgccggcggggtggcctacctggatgacatc

SEQ ID NO: 378918 - DNA, 1311 bp, Homo sapiens
tagagggcgggcctgagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtgaggttcaggctggggcagctggggtggctggggccttagggccaggtagggattggattcctgggtttctggctgtgggtctgggctggcgcccccagcaccttctcagccctgcctgtctctgtaggtctactctctggtggtcatccttcccaagaccccgctgaaggagcgcatctccctgccttgtgagcagctggccggcggctctgggacaggcggggatgggagggagtctaccgggccactgtagagctggtagctgggagctggagctgtagagttccaggctgggagctggagagccc

SEQ ID NO: 378919 - DNA, 2186 bp, Homo sapiens
cgttaactctagaggaccccctccggctggtactccttggtaagcgtaacaccggtcgcgcatgctcttccttgacctcattcaggagggcacctcggctcattcggaagcgcacgtggcgcgtcctcagctttccagtcttcgattccgcccgctttccgagtgagaaacgcaggcctctctcttccgtgaagcagcgtcttgtctctgcacctcctctgtgctgtctctttaagagtgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378920 - DNA, 2191 bp, Homo sapiens
cgctgtgcgcgtgcgctcgcctgcgctgtggtgggagctggagcggaggtcagtaggcatccagcgctggggcagctgcttcaggacatcgccgaggacaagtctcctccccattctggttccaccatctgtagcctgtggctttcatcctcaagggctccatgcgaccgctgcacatccaggacaggagcaaggagaagaatgggacccaatctcattccagcccagcggtgctgtcgcaagtgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378921 - DNA, 2296 bp, Homo sapiens
agcggggccgcggcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagtgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtgaggttcaggctggggcagctggggtggctggggccttagggccaggtagggattggattcctgggtttctggctgtgggtctgggctggcgcccccagcaccttctcagccctgcctgtctctgtaggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcgggtgagtctgtggccgccggcgcccccgcgtggctgccggcggaactgcgccttcttccagcatgggtgtgaggattgaagctgagaggctgtgtatgcatacagtgcgcatgcgcacgcacatacatacatgcacttgggcacacacatacagatacacatgcacatgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaat

SEQ ID NO: 378922 - DNA, 331 bp, Homo sapiens
aattgagttacaggagaatactgtgaacaattgtacagctaaaagtaataatctaaattaaatgtacacattcctagaaacacacaaatcacaaaaactgactcaaggagaaatagaatatctcaacagacctataacaactaaagatatggaatcagtaaccaaaagccttccaacaaagaaaagcccaggaatagatgatcttcactgatggattctaccaaacatttaagaaagaattaacactaattctactcaaactcttccacaaaaaataagagaagagtagagaaaactttctaaaatatcttatgagggcagcattaccgtg

SEQ ID NO: 378923 - DNA, 462 bp, Homo sapiens
ggtattatatcatcataagccagagcaaaaggaaaataacaactgcattttaataaaattaagggtatttatgatttgattccagtaagtgctaaaaccagagtgtgtggagtagtcaagccttaaatttgttagtgcacaaaaggttgatttattacattttagttgttagagtccaaaggagataggcacaacttatctacatataaaaatatacatagagatacatacgtgtgtgtacccaatatatacacgcagacacataatacacataaaagcttattaaaaacaaccaaattctattttaatcctcttaaaaaggtaaaaagctgcatcgtcaattttgctgtgcgtttcccataatctcagttaatgcctctggggaagagagctgaattttggcaacagtatgtaacttggtaattggacacaactccaagtcatttgctaggactccaagtt

SEQ ID NO: 378924 - DNA, 268 bp, Homo sapiens
gaactgtagacatttaactcatagattagagattgtaataggaaattggagaggtatatgcccccaggtgaaacattggtcaagtctttatgagatagtattgaacctaatgcagaattttattcttctccatttttatattattgtttactatataaattaaacagccatttagttgcatctctaggtggtttttgttttcctctgacacttacttgaatgttctcctataaagtactgagcataataacttacttttaaatcacat

SEQ ID NO: 378925 - DNA, 383 bp, Homo sapiens
aaataactcccacaagtttagtattccaataatggaacactaggcataaatggattaagttgacacataaaattaaccatgacattcaattaccttattagattgtcataaagattaagtgagttaatatatgacaagcacttaaaatagtgtcacacacatagtagcaatatacgttacttgctattattaatgtcattactattattatgttagtggttttgttctcttcatttctgtatcctcattgccaaaaataatgcttggagcttagtatgtgctcacttaatatttgttgagtgaattaaaatgatttaataaatataaacttcatatgtaaaataatagaacctaaatatttctacttgcaaaatgtgtattat

SEQ ID NO: 378926 - DNA, 1168 bp, Homo sapiens
catagtttatgtgttaataggcgctaactcttacagttagcacctactattcaaactgttgaagaagtcgtggtcttttgcctacacctgattcaatgcctgttaaagagataccggattccacctaacgtctgcacaaaggataataaacacagcaacagtgatcaacagctactattgttttcctcctgtcaccagactattatgacttggcagttctgctgtctcttcgttccactgtcagttctttacttccaacagttaagagccacacaaagtaaataaataagacaggacttagtaagaatttagtgctaataagaggcaagaagtaagaaattcttctcatggttaagtctctggaactctactccctggattcaaatcccagccttgtgatttttccggtgtgtgatctttaacaagtatttaatctctctgtgcctcagtttcctcaattataaaattaagatagattttgtctattttatagggttgttgtgaggattaaattagtgaatacgtgtaaagtgctcaaaatggtgtctggtacatagtaaatactgtaaaatgctttctgctgttaccactgctgttgttactggtatcaatgtgactgtcatatcgttttcttctaatctgttgccttatttgacatagcaagccctaatagaaggcctagcatcactgggttccaaatcagaaagtccatgcattttcaaaccttataacatgaatttttttgtttaaaaaagccagcatcctggggcctaccctcattaggccttctataccactaataaatatatctttttaggcaacctaagtagtctgaagcaagttgtctatggctacattttgaaaaacagtgttctgtagaagttttacacatacatgtttttctggattcatgcttctctgccatttgaaagactgtagttgtcaatgatagactggattaagaaaatgtggcacatatacaccatggaatactacgcagccataaaaaaggatgagttcatgtcctctgtagggacatggatgaagctggaaaccatcattctcagcaaactatcgcaaggacaaaaaaccaaacaccacatgttctcactcataggtgggaaatgaacaatgagaacacatggacacaggaaggggaacatcacac

SEQ ID NO: 378927 - DNA, 1282 bp, Homo sapiens
catagtttatgtgttaataggcgctaactcttacagttagcacctactattcaaactgttgaagaagtcgtggtcttttgcctacacctgattcaatgcctgttaaagagataccggattccacctaacgtctgcacaaaggataataaacacagcaacagtgatcaacagctactattgttttcctcctgtcaccagactattatgacttggcagttctgctgtctcttcgttccactgtcagttctttacttccaacagttaagagccacacaaagtaaataaataagacaggacttagtaagaatttagtgctaataagaggcaagaagtaagaaattcttctcatggttaagtctctggaactctactccctggattcaaatcccagccttgtgatttttccggtgtgtgatctttaacaagtatttaatctctctgtgcctcagtttcctcaattataaaattaagatagattttgtctattttatagggttgttgtgaggattaaattagtgaatacgtgtaaagtgctcaaaatggtgtctggtacatagtaaatactgtaaaatgctttctgctgttaccactgctgttgttactggtatcaatgtgactgtcatatcgttttcttctaatctgttgccttatttgacatagcaagccctaatagaaggcctagcatcactgggttccaaatcagaaagtccatgcattttcaaaccttataacatgaatttttttgtttaaaaaagccagcatcctggggcctaccctcattaggccttctataccactaataaatatatctttttaggcaacctaaaaaaaaaaaaaaaaaaaaaaaaaaaaaaaaaaaaaaaaaaaaaaaaaaaaaaaaaaaaaaaaaaaaaaaaaaaaaagagaagaagaagagaggagggggggcggcgccccaaggttctctcttccatagagggggggcgacaaaaagtagcggcacgcgacaacaccacagtgtaatggtgtgtgacaagaagggggcgcgcccatatatatatggggtcggtatgatattataataagcacacgaggcgagcggggcgcggcgcgctgcggggatagaaaacacacgcggcgcgagaccgagaggcggagagaaaaaagcgcgcgagaacaacggaggcagagcgcactctctcttggagaaagaagcggacgcacctcactttctctctatctggggggggagggaaagaactagatgcgggaagacaaaataactccctaccgaacgaattgg

SEQ ID NO: 378928 - DNA, 809 bp, Homo sapiens
ggcccagaaaggggcttctataccttcactggtcctcagtagctcctgtgacctactgcccagactgatgcccacagacccagagacaaacttggattttacggagcccaaggccatgaagggttaaggccaacactgagtattatagtgtgaacctataaactgaaatccttatttggcctgcacagctttctttttggcttggtgtcctgggatgctgggagtggccatgtctttatttgctcaacccttccttgtatggaggcaggaggctggaagtgccaactttcttttccatcatggggatactgaggcatatggtacatctcagacactagatccaaagctagttccaggaagggattccagcctgcagcccctaacctccacaacgactctgctcagtcctggcccctggacattaacgaaggcagtgacaagccccacaccccccaaactggtagctgcaatatctacattttcccacggaagtctctgtgtacaaagatgcaactcccgcagctgggtgtcgtggctcacacctataatcccagcactttgagaggtcaagacaggaggatcccttggggccaggagttcaaaaccagcctaggcaacatagccagaccccaactctagaaaaattttaaaaaattagccaggtatggtggcatgtgctctagtcctagctacccaggaggctgaggctggaggtctcttgagtccaggagtttgacactgcagtgagtccatgatcgtgccatcatgctctagcctgggtgacagaacgagatcctgtccctttaaag

SEQ ID NO: 378929 - DNA, 135 bp, Homo sapiens
ttttttttgatctgataactgagggacagcaactaagtgaataaagggtaggtaacgtgtacagtgttgatatgctgaacaaagagatgattcacatcctggtcaaatggagtggaacaggacaagatttcatga

SEQ ID NO: 378930 - DNA, 316 bp, Homo sapiens
ctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaat

SEQ ID NO: 378931 - DNA, 406 bp, Homo sapiens
agactagccagagcatgtgctgtaggccagcggttaatacattttattgggagaggtcagcatctgatcgttaaaaagttaacattgagccacacacggggacaagagtcaccaatctctgcccgagatcagctacctaaggccacactgaatttcaggaggtaatatatccctagctgagttcctgatgtgttctttctgcaatgtgtgcccctgccccatctctgttactggtagctccgtccttccatttctttaggccaaaaaccttggtgccatccttagcgattctctcacactctacatcaaatccacaagcaattccaatggtctctactttccaagcatggcccgcactgaccgttcttaccacaccaattggcacacgctggccttgccgtcgacc

SEQ ID NO: 378932 - DNA, 209 bp, Homo sapiens
agactagccagagcatgtgctgtaggccagcggttaatacattttattgggagaggtcagcatctgatcgttaaaaagttaacattgagccacacacggggacaagagtcaccaatctctgcccgagatcagctacctaaggccacactgaatttcaggaggtaatatatccattacttgacctgtcttttaaaacagagtggtagacc

SEQ ID NO: 378933 - DNA, 529 bp, Homo sapiens
gacaaagcatttttctgggtgaaggctcaaaatctcatcagatttatgtcgtggtttccgaagatagtaatgatgacatgctttgaaagctaatgttttacatttactcagaaggctttcatgaggttatgacatgggcagatgatttaataagacagttatggtttcatgtgaaactcctttgcagagagatgcccatacacactgatgggcatgctgagtccctggtctaggtgtgttaaggtaggggtaggggctttgccttcccatcttgattccctcccatggaacatgcataagcttctagctgttgcctaagcatgaggagtcccattgtctttcttaggagtccttgaagagttttaaacagccatttacatcacagatattggatctgctgttaatgaaattgtacctgcattggtatactcataatggttgttctgaaaggtattattatttaatatgtcactgaaatagtttgtattataagaaaaactgctgtctatggggtttctgtattagcatt

SEQ ID NO: 378934 - DNA, 453 bp, Homo sapiens
caaaattattttctcaacaaatatcaattacttgtttattaatccgacatgtattaaaccatctactgtgacagacagcatgctagacttcatgttgcagaaaaaaagcagacaaaatctctgaccttgaagagttcaaaagccaatagagagtcctccttacctgcaagagatacattccaagacccccagaggatgcctgaaaccacacatagtaccaaacgctatatatactagttttttggtctgataaccaagaggactaccaagtaactagtggtcaggcagcatatgctgagtagatatgctggataaagaaatgattcacgtcctgggtgggatggagcagaaaggggcaagatttcatcatgctactcagaacagtgcaaaatttaaaacttatgaattctttatttatggaattttccatttaatattttcagaccactgttg

SEQ ID NO: 378935 - DNA, 953 bp, Homo sapiens
ctccagaccctcggcatccctccagccagagtccaagtccctggctcatgcctgcaaccgcatgagtttcatgcatttttccccttctttgttctcaatgtcttagcacatgatggctccctgctactgaggtcttacaagagacccttgagaaatctatttcttattgagactattctgaaagacactaagcatgcttgcttttgaacaacttttaacaaaaagaacaggaagagtttaaataccatgagctgtggagggtgaagagaggaataaaattgcattgttctggccagaccagattctggaatggcttcttagcatcccttcgctgcatcctctgactggcgccgtgagggttaattttatgaaacttgaatgggccacaagtggtcaaatatttggtcaaacattattctggatgagtgtgtctgctttttggatgagattaacatttaaaccggtagacaaagtatagcaaatttgacttccctaatgagagtgggcctcattcaaagatctggacagaacataaaagggtgtcccccaccccgaatatgaggggatccctcctgcttgactgctttaaagctgggacattggctttttcctgcctttggactttgaactgatataaatgctcttcccaggactcgagcctgctggctttcagactgaaactcatacaatcagctctccggggtctccagcttgccacctgcagatcttgggactcaccatcctctaaccatgtaagtcaattgtttatatcaataaatctctttctggagaggtgcagtggctcatgcctataatcctagcactctgggaagccaaggcaggaggatcgcttgaagccaggagttcaagaccagcctgggcaacatagcacgaccagcccctgctcccctccgctcctgtctcttcaaaaaataaaaataattggccaggcg

SEQ ID NO: 378936 - DNA, 899 bp, Homo sapiens
ctccagaccctcggcatccctccagccagagtccaagtccctggctcatgcctgcaaccgcatgagtttcatgcatttttccccttctttgttctcaatgtcttagcacatgatggctccctgctactgaggtcttacaagagacccttgagaaatctatttcttattgagactattctgaaagacactaagcatgcttgcttttgaacaacttttaacaaaaagaacaggaagagtttaaataccatgagctgtggagggtgaagagaggaataaaattgcattgttctggccagaccagattctggaatggatgaaacttgaatgggccacaagtggtcaaatatttggtcaaacattattctggatgagtgtgtctgctttttggatgagattaacatttaaaccggtagacaaagtatagcaaatttgacttccctaatgagagtgggcctcattcaaagatctggacagaacataaaagggtgtcccccaccccgaatatgaggggatccctcctgcttgactgctttaaagctgggacattggctttttcctgcctttggactttgaactgatataaatgctcttcccaggactcgagcctgctggctttcagactgaaactcatacaatcagctctccggggtctccagcttgccacctgcagatcttgggactcaccatcctctaaccatgtaagtcaattgtttatatcaataaatctctttctggagaggtgcagtggctcatgcctataatcctagcactctgggaagccaaggcaggaggatcgcttgaagccaggagttcaagaccagcctgggcaacatagcacgaccagcccctgctcccctccgctcctgtctcttcaaaaaataaaaataattggccaggcg

SEQ ID NO: 378937 - DNA, 357 bp, Homo sapiens
tgcccttttcccttgctcaagtttatgaggtaattttaaatgtatgttctgtttcttagtgttaattacatgacattatgtgcactttaatttactaatatggggagctacatagaataaccattttaagaataaaagttgaactttttaattgcaaactaaccagtcactgctgatgaggtatttcaagcttcttcaaggagtgccaagacatataaatgcttaaagatttttgtgatttggattctaatgaagtgaatctgcagggcagagttgagaacaatgaatgagcaacataaatatttggagatacctattcagaatagaggtaaagctgtttgtagttacacttggtag

SEQ ID NO: 378938 - DNA, 682 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378939 - DNA, 2392 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378940 - DNA, 1834 bp, Homo sapiens
aagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378941 - DNA, 1370 bp, Homo sapiens
gtatgtggcgatctagaggacccccggtagattggacctctcggaagattggacctctccggaagatggacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378942 - DNA, 2245 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378943 - DNA, 2019 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgtaatgagagcaggactctctggaccacagtcgcagttttttcagttaatgaggtattaaagaccagccctcccttctcagtataatagctgtctgtcttaatggt

SEQ ID NO: 378944 - DNA, 2120 bp, Homo sapiens
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgaaaaatga

SEQ ID NO: 378945 - DNA, 564 bp, Homo sapiens
ataatttcatctgacattgagtccacgttcagattttcctaattgcacccacaatgtctcatatcttctttctcctccctccattcatgatccatgcagtgaacttttttgtgttgttttgttttttaagagacagagtctcacttttttgcccaggctgggcaatggtgtcatcatagctcactgcagcctcaaaatactgggctcaagcaacactcccacctcagcatttcaaattgatggaattatggatgcgtgccaccatgcccagctaattttttttaagagatggggtctttctgtgttgccccatctggtctttttttttcccttctttttctttttcttttgaggcacagtgttgctctgtcacagagtagtggtgcgatatcggctcactgcaacctccgcctcccaggttcaagtgattcgcatgcctgtaatcccagctactcgggagactgaggtaggataattgcttgaacctgggagctggaggttgtggtgagccgagattgcgccattgcactccagcctgggcaacaagagtgaaactctgcctca

SEQ ID NO: 378946 - DNA, 483 bp, Homo sapiens
  misc_feature (169)..(169): n is a, c, g, or t
  misc_feature (469)..(469): n is a, c, g, or t
  misc_feature (474)..(474): n is a, c, g, or t
  misc_feature (480)..(480): n is a, c, g, or t
gccttctctctgcctcatgcaaaggcaaagtcattctcacctcagtgtcttttcatttgctgctccctgtgcctaagatgttctccccagattcccatggtcatctccttctcatcattcaggtcttagctcaaatgtttcctcctatgaaaggcctttcctgaccacncctggtaacgcagtcccttccttacctggtaagggacttagcagtttaccctatatcccaatacctgatttcatttttttcatagcacttcctaatatctgaatttttttttttttttttttgagacggagtttcactcttgttgtccaggctggagtgcaatggtgtgatctcggctcaccacaacctccgccttccaggttcaagtgattctcctgggaggcaggggttgcggtgagctgagatcgtgccactgcactccagcctgggctacagagtgagactctgtctcaaaaaacnaaacnaaaacnaaa

SEQ ID NO: 378947 - DNA, 711 bp, Homo sapiens
  misc_feature (169)..(169): n is a, c, g, or t
gccttctctctgcctcatgcaaaggcaaagtcattctcacctcagtgtcttttcatttgctgctccctgtgcctaagatgttctccccagattcccatggtcatctccttctcatcattcaggtcttagctcaaatgtttcctcctatgaaaggcctttcctgaccacncctggtaacgcagtcccttccttacctggtaagggacttagcagtttaccctatatcccaatacctgatttcatttttttcatagcacttcctaatatctgaatttttttttttttttttttgagacggagtttcactcttgttgtccaggctggagtgcaatggtgtgatctcggctcaccacaacctccgccttccaggttcaagtgattctcctgcctcagcctcccgagtagctgggattaccggcatgcaccaccacacccggctaattttgtatttttagtagagacggggtttctccatgttggtcaggctggtctcgaactcctgacctcaggtgatctgcccgcctcagcctcccaaagtgttgggaccacaggcgtgagccaccgtgcccagccactatctgaaatttttatttgttcttataatgtctgtctccccacaccagagtcttgaaacattcctggcacacagcagtttcacaacaaataactactaataagtaacttcctaatttttaaaaaaagtatgataaa

SEQ ID NO: 378948 - DNA, 882 bp, Homo sapiens
taaatatgtgaaaagctcccatctccctattttgcctcccctccaacataaaatgagtacagatttagaatttcattggttaaatatatctttgagtattcattaaaaaaaaaaacaaactttagcagtggttactcaaaatcttgccatagtcagttctgcagtatccactaaaagacttagatttttatcaaaatttctttccccctaaagtctatgtggtggagctttcttttagaatcatcaaccagtttgttcttggcattaaacattatcttttctcattaaagctctaatttttttaaaaaaagctaatgatgaaaattttagttataatttaaatgaaatttgcatgtacaattgtcagtaaggactatgaaacataaacaattacataatttttgagatgcagcagatcctaggaaactcactcagtcctgtggttgccaacctttctccatctcccgcagacgttctactgcatgccagataccatgtgcagtaacttctgaatcctctcatccccctacttccagaacacaggactatgagttacttgaaagctgaggcttggtagagggctggagccaattgcgttaaactaactaacattattgcaaaatatattctagggcttttactctaataaaaatgactcctggaactgcagtactatattcttggaaccccaagaaaccaggtgacaacccataaatttaccatcacttttcagatgaggaaggcaaatctggaaggccaaattacttgtccaaagatagacaccaaaccagtaaaggagcaggatttgatggagggaggatgaagtatcaatgaaaaaataagtctaagtaaagaaatgcaaatatctttttctttaaaaaa

SEQ ID NO: 378949 - DNA, 887 bp, Homo sapiens
agcttgggcaacagagtgagactcagactcaaaaaaaaaaaaaaagaaaagttaatgcatctaaatttattgcaaagggaaaataaaaatgaaacaaacattattgttgagagtttgtttatcctatggtgctcctaagtataaacaaattttacactcaagaataaatttgttaatgtgaaatatccaatttatatcactgaaaagtataaaataaatgttttgtattggtttatactgtaattaactaaaactcatttccttttcattagggcataggaagtcgattcattttgcatacttggtagcacaaagttcaaatgactttaatatctggcttaaaataagttgggataatatgttctggggagtaaggaacaaggacttcacagaaggagcttgtattcagttcaagtatctgtagaggcacatagatattagcagaaaaccctaagtattgactccatgaatgcattttctaattttaactcaaagtaatcttaggacaaaggatctaaaactgattcttggttagtcactcttcattcactcatgtgttatttactaagtatcttctaaggatcaggcatttacccttatggagcatttagtctagcaggaaaagtagtcagagaaccctagctaagccaggctatctcaggagggaagaaatgaaaagaggtcaactactatttggccaggcgtggtggctcacacctgtaatcccaacactttgggaggcccaggctggtggatttcttgaacccagaagttcaagagcagcctgggcaacagagtaaaaccctccccaccgccgccatctctatttaaaaaacaaaacaaaacaaaaaaactccagcctgggcgacagagcgagactccatctc

SEQ ID NO: 378950 - DNA, 832 bp, Homo sapiens
agcttgggcaacagagtgagactcagactcaaaaaaaaaaaaaaagaaaagttaatgcatctaaatttattgcaaagggaaaataaaaatgaaacaaacattattgttgagagtttgtttatcctatggtgctcctaagtataaacaaattttacactcaagaataaatttgttaatgtgaaatatccaatttatatcactgaaaagtataaaataaatgttttgtattggtttatactgtaattaactaaaactcatttccttttcattagggcataggaagtcgattcattttgcatacttggtagcacaaagttcaaatgactttaatatctggcttaaaataagttgggataatatgttctggggagtaaggaacaaggacttcacagaaggagcttgtattcagttcaagtatctgtagaggcacatagatattagcagaaaaccctaagtattgactccatgaatgcattttctaattttaactcaaagtaatcttaggacaaaggatctaaaactgattcttggttagtcactcttcattcactcatgtgttatttactaagtatcttctaaggatcaggcatttacccttatggagcatttagtctagcaggaaaagtagtcagagaaccctagctaagccaggctatctcaggagggaagaaatgaactttgggaggcccaggctggtggatttcttgaacccagaagttcaagagcagcctgggcaacagagtaaaaccctccccaccgccgccatctctatttaaaaaacaaaacaaaacaaaaaaactccagcctgggcgacagagcgagactccatctc

SEQ ID NO: 378951 - DNA, 328 bp, Homo sapiens
ctggatgacatttctagacatgcttcaggccagaaaggagcctgctgcctgggaaagaatgacctagtcctggtaggattcattacctgctaactgaagagtctgagtgccttgaataaccagcagtgatacccgggaactacgttgagggccttgggtgataatttgagatctgctggcttcaggagagactcgacacattctcaactgtggtggctatgaagtcagactctctgcttgagaagagtagagggaaaagtaaagggcacttggtcttggacttgatctgtgaccagatcagccacagggagctagagcaccacgtggg

SEQ ID NO: 378952 - DNA, 442 bp, Homo sapiens
acagaattggaaccaggcagtccctgtgtgcttccgaattatgagagagtggtaactcagaagaagcacgttcatgcatttatctaatgaacattgattagacatgtgctgcatgccaggcattgttttagccacttgggttacagatatcctcatgaaacctatattgctagtaggtgaaaatacacaatagacagtcaacattatccgttagtgagttgcatgtaaagaaagtgcgtgaacaatgagaacacatggacacaggaaggggaacatcacacacgggggcctgttgtgggtggggggagggggaagggatagcattaggagatatacctaatgttaaatgacgagttaatgggtgcagcacaccaacatggcacatgtatacaaatgtaactaacctgcacgttgtgcacatgtaccctaaaacttaaagtat

SEQ ID NO: 378953 - DNA, 1130 bp, Homo sapiens
ctactctctccattttcagaagttgtccttggcaccctctcttcgtaattccagcctccgcacctcttgtgtttatactgtttcctcgttgccactggccaatgtggacagtctacttcctttcccatccagggctcccactaacatgccttcaactcacaaagtcttaaaatgaattgccttgtattttatccaccaacggagagcctccaattcttcccataatgaaattagtttgataaaaattcaggatattgtaataatgggagaaggcaaaagaggacccctccgtcttcatcattccctcagaaatggtatcaacaattttatgcccttgagtcatagcatgtaggaagaggtgagagcacaaaaataatctttaaggagttaacagagtacttctaatatttgcctactctgtgttttccaaaccttgcttcctcacagatttttttttcctgtttttctctgtactgcttactctattgaaggaatggctgtgggtaatattcagtattcaactcaacagggcctatcctcatgatctctagcgtggatacagtggagtccttcactgtcacagtaaaaccttaagttggcacactggtttgagtagagaagttaatgagtaatgaccactgacgcagacagagtatcaaatgcaattaataggtttaataaacaggagtagttaagtagacaatgattcctcagcagattatgggatgggtatgctctagtctggagttccacaagttgttctgagtgtggttaacccacatggacttttctacacgagtttttatttataaacataatatacaaacagacactaattttgccacatccatcctgaactattaaaacaaagttggaaggaacaatagaagaacgaagtctggtttaatgcagataatcaaacagctatgctccattaaaacatctcatgagtcaaatgcactccgtttgtttgtttgtttgtttgtttgtttgttttgagacagagtttcactcgtgtcacccaggctggagtgcaatggcgcgatctcggctcactacaaccaacacctctcaggttaaagcaattctcctgcctcagcctccccagtagctgggattacaggtgcaca

SEQ ID NO: 378954 - DNA, 513 bp, Homo sapiens
tcctggtttctgacacagagctcctaaaacacttgtaatctcctgagtaacacaggtgctaagaggagtttttgttctagtatttggtctctggccttggtcctgatacgagcacctaaacctcatggaatttcccggaagacaggagccttttgctctaatgaaggaagtcttagtgggctcctagatagcttcaggatggggctagtcaccaaaaggaccaagtcatgattagaaacttagaactttcagccctaatcccccaccctccagggagaagggaggggctggagactgagttaacaatcaatcatgcctacatgatgaaccctccataaaaatccctaaacaatgggatttggagcgtttccgggctggtgaacacatccatgtgctgggaagggggcacaccccaactcctgtgctcaggacacttctggacctcgccctatgcacctcttcatctagcgttcatctgtgtcctttataataaatcagtaaatgtaagtaaat

SEQ ID NO: 378955 - DNA, 687 bp, Homo sapiens
aaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgttggataagtggccttgaataaattagttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgctctgtagatctca

SEQ ID NO: 378956 - DNA, 393 bp, Homo sapiens
ctgggcaacatagcaagaccttgtttcaaataaagtatgaaagtaaaatggtataaagaagtccatttattcattatctagtatcgacaatgaccaactaataagttgattgtttcatctattatctcctctctatctaaagcaaaccccagataacatttcatttcatccataaatatttcagcatgtatctccaaaagataaagacttgtttaaaaaacaaaatgtgggctgggcctgatggcttatgcctgtaaacccagagctttgggaggctgaggtatgagaccacttgaggccaggagttcaatcaagaccagcctgggcaacacagtgagacccccacctgtacaagatattttttaaaaaattagctgggtgtggtagcacata

SEQ ID NO: 378957 - DNA, 442 bp, Homo sapiens
gctctctacatttaaaagacaaacagaaaagctctccaaggttaagaaaatctattgcttaaactaatcaaacctcaaaaattccatggcaatcaggtacagtttctttaattggaatgtgggcagaggctcactcacatcaaagatagagatagttgagcatgaaggttcacgactatagtctcagcactctgggtggccgagcaggaggatcactggagcctaggatttgaagaccaccctgggcaacatagggagaccccatctctacagaattaaaaatttgttaaaagtctagccaggcatggtggtgcatacctgtggtcctagacactcccgagactgaggtaggagaatctcttgggctgggaagttgaagatcgcaccactgcacaacagtactctgggtaacagagcaagaccctgcctcataaaaacaaac

SEQ ID NO: 378958 - DNA, 1708 bp, Homo sapiens
gaattccgggatatcgtcgacccacgcgtccggctttgtaagctattggtgttgggataaaactcactgtttatgctgacaccaattcaaggttacttggagattttgtttttcttatacagttaagtcagttctagctaaaacataaacactgcaaactcatttgaaactgaagggaaaagggggtggtggtaaaagaggcttttctaaattattaaacttccctgaaatgtgcttgacccaaaattttggtccacaaccttcactggattaccaatcagacaaagtttagccatgtggacaggtctcaattttgtcagaaataatttggatccagctatgtcttttataggctggtgactttgtgatgctgtcttatgattagagttccaaggtaaaagatacaggatctttgattttgtgtgtatatgtgttcatatgtgtatgtacatgtattatgttaaagtcatgtccagcatgttgccaaattggcttataagtaaatgattactcacaaattaagtaaatccaaatgcttttcaagttcacataaatttagtaatctttggtaaataaaaataattttaaaattattagtaaaacaaaactagaaatgcctttggaattgtaagcatacattttttatgtgggcttacagattattttatattttgcctctgctagaaattttaaggtgtcaggggttggcacaaccacaaaagttataagagtacaaacccaaccaaaaaaagaataatctttgtttatgtgaattttttgacaaataagactaatttaagattgctaattcaataaaaacacctgaattttctgagttatcagcaagatgctcatgtgtttcactttaaggttctttcttaggtgaatacttggtattccaagggtacactaaatggttaacaagaaaataacttgaaatgatgactagctttgtctaatatctcagttttcagaaataatttggataaaatgttaataattaaagaatttctgggtaaagtggctcacacctgtaatgccaacactttgggaggccaaggtagaagtattgcttgagctcaggggttcaaaagcaggccctggcaacataggcccctatctctaaacaaattttcttaaaatttaaaaaatatttttagctgagcatgttggctcacaactgtgtccccagatattcaggaaatttaggtggaagaatcacttgagtctgggagattgaagctacagcgagccatgagcatgccacttcactccagcctgggcaatagaacaaaaccctgtctcaaaaataaataaataaataagtacatgtaaatgggatacatgctcacttataaattttgtaatttaaaatcttaaaattattttgaattgaatagtagatgcttgttggatgtctgggtaattttcaattaagaaagggttatcatatggaaaacatgttactaaaaattgtggagtggtttcatctataaaatgttaacatctgagagtcaggtaacaatttgctgcttcctaaaatttaaggctactaagaacaagaattctagttaatacataattctgtaagttgtgtttttattaagaaaagaggtaattataaagttatgaaagaaggtaggaagaaacaagtaggaggaataatgcaaagatacttaaggatatgaagatgtatttttgtagggaa

SEQ ID NO: 378959 - DNA, 2117 bp, Homo sapiens
gctgggaatatgctgggggaagacacaggccttgtttcaaaacaatctacctacttgtcatctggacactgtcctggctacttcagggacaccattccagttaaccttcgcagcaatcctgggccctattttacagatgagcttatatgctgtatgaaagtcacgtgaaccccagaactgggatttgaacccaggtctgccctatggcagacgccgtgtatgtaatcttcatattacattggaaaaagctacctattcaaggcacatattcaaggcataatggctcctgcctcaaaagcctccttgctgactgtgcttccaagcctcaaacagagacacacagcctatccacagggcagaaaagtgaagtcaggccagtcctggaaaggctcagatctctctggcctcagatccctcctctgcaaagtgagcaggcagcctgggtctcagggatttggcccagcgtcagtgtccctgaagctctctgccaagtgccgggaaagggcactggagaagagaggtcagaggagatgcatgactgtgagtaccctcatccttgctctgggtatgacagtcaccctggaatgagggagcttggcaaagggttttatcctccactgtattttgctcttgattctgggcaggatccagctcctgccttgccctcagtgctgagtgaccttaagaatctctgggctcaaagcatcccctttgagagtattatgtgtcttcagcattgacttcaatatctggcatggagtaggtgctcaccagtgtttgctgaatgcatgagaagaggtggggagtggaagcggggatgccttccacaggcctcttctgaagcaccctgggcctggcccactctttgcagggcccctctgccccatgttgccctaactctgaacagggatcaaaagaaagcctggtggttcaggtcttcccagtactctgggagctcctgggatgacaggcattcggggcagggtctcactggggccctcaaatatggcatatggacacagattctcatgccattccagatttctggccatccaaattctccctgtccttaagtcctagtccagggtccacctactccagggggtctactggaaacagagcacctgttttctgactttctagtgccctgagtgggaaccacttcactgggctcttgttcccatgctgttgtgtgttgctttgtatgtagttcttggcctacctaatggccctgaggatcagaagtaaatggtctctgtttccaatctgtctcctaggagtggactggtcaaagagagtaggcaggggcaaagtagaagactaaggatttaaacgcaatgtgctgaaacatcaatggatgataaaacaagtgggtaaaaaaaaaggtatgagaaacaatatttacatagcctcaaagtatacccccacaaaatacttatacattacaaagggaaagttagtaattttattatacaaggagaaacctggcagataccaccttaaccaggtgatcaaagtaagtatcatctggaatgtaatatgtaacaaatgctatcatgggcctcctggtcagatgtgttcaaaaggagacagtgtcacttattcttgctgagaatgcataaccagaatctaatcataaggaaacaagacaaacccaaaatgttctatgaagtaaatggcttgtgctcatttaaagagacaagacaactaaatgtaacttgtgatccttggccagaatttctttcttttttttgtttttgttttttggttacaaaggatattagttcaacaactggcaacacttaaataagatcaggtactgtgtcagcattgatttcttaattttgatacctgtactgtggttatataagaggctgtccttgtttaggaaatatatactgaactttttggggaaataaggatattaggtcagcaatttactctcaaatgtttccagaaaaaagtaataatacagtgtttatatgtgtgtgagagagtatgataaagcaaacaagttaaatgttaacacttggggaatatgagtaaagggtataaaagtattccttgtgttatttctaaaacttctctgtatgtctgacttcaaaataaaatgtatg

SEQ ID NO: 378960 - DNA, 655 bp, Homo sapiens
aagaatttgcttttcactctgaaaaggcattctttttaacccagtaaaattcaaaatgcgaactgtatttttaaaatattagcaagcaatattttataatagattatgagcagttgtatttcttgtgcccttggtaatgtatttcaaagctgggtctcttttaatactatttctacaaaatctttttacatagggatgacacatagaaagtgaaaattaaattatgcatatgcccatgcttctcattcttacctccaagaaagcatcgctgaaaccttgccactaactcaaggtattctgtcttttgaattctgtcgtgactggggctaaacaactgtcattggcaagtgacaagaggcacagacagcaggggaaagaaaaagagagaaaagaagtaggcgtaggagaaaataaaagcctaagagatggggaggaaaaatacccagtatcttccaggagggtaaggatgctggaagcaactgtctcgggtgccagtttgttggtgctcaagcaacgatctgcctactcctgctatatccagatgcttttaatgtcttttttggaatctagaaagtactaagaaatgtctcaaagtacagactgatgttatcattacatttaaatttgcctaaagaattctgccagttctccaatt

SEQ ID NO: 378961 - DNA, 384 bp, Homo sapiens
agcttgagagcgtagtgttcatattcagagtgtacatacttgtatccctttctccttctctggataccagctgtgtgactctggaagataagtctgttttcttgctgtcttataatagagaagtaagttatgtggctgaagtctgtagttgctgcagtctctgctccactgtacataaattctctaccatgtctaaaagaggacattactctgcagcaacctgagactacataacctatgatatggtgaatgggtatgtgtcagctggcttataaagatgtttgttaggaagtgacttgcatcctctatctgcttatgtcttattggtgaaaacatactcacactcggttgcaaagaggttttgagatgtagttttattcccag

SEQ ID NO: 378962 - DNA, 879 bp, Homo sapiens
aaaaggtggggccggaggcggcgagctgagcggctctgacaggacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccagccttgcccttcaccttcaccttcatgctggtcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaac

SEQ ID NO: 378963 - DNA, 412 bp, Homo sapiens
cttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtatatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctac

SEQ ID NO: 378964 - DNA, 444 bp, Homo sapiens
caaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagcccaagcaacagagcaagaccctgtctcca

SEQ ID NO: 378965 - DNA, 421 bp, Homo sapiens
cttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtatatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgagcctgggaagacttcagtgagccatggttgtgccactgcactctagcccaagcaacagagcaagaccctgtctcca

SEQ ID NO: 378966 - DNA, 1609 bp, Homo sapiens
caccattaggcaaagatagtttctctagagagaatcatgcctgctaattacacgtgtaccaggccagatggagacaatacagattttcgatactttatttatgcagtgacatacactgtcattcttgtgccaggtctcatagggaatatattagccctgtgggtattctatggttatatgaaagaaacaaaacgagctgtgatatttatgataaacttagccattgctgacttactacaagttctttccttgccactgaggatcttctactacttgaatcatgactggccatttgggcctggtctctgcatgttctgtttctacctgaagtatgtcaacatgtatgcaagcatctacttcttggtctgcatcagtgtgcgacgattttggtttctcatgtacccctttcgcttccatgactgcaaacagaaatatgacctgtacatcagcattgctggctggctgatcatctgccttgcctgtgtactctttccactcctcagaaccagtgatgatacctctggcaataggaccaaatgctttgtggatcttcctaccaggaatgtcaacctggcccagtccgttgttatgatgaccattggcgagttgattgggtttgtaactccgcttctgattgtcctatattgtacctggaagacggttttatcactgcaagataaatatcccatggcccaagatcttggagagaaacagaaagccttgaagatgattctaacctgtgcaggggtattcctaatttgctttgcaccttatcatttcagttttcctttagatttcctggtgaagtccaatgaaattaaaagctgcctagccagaagggtgattctaatatttcattctgtggcattgtgtcttgctagtctgaattcatgtcttgacccagtcatatactacttttccactaatgagttccgaagacggctttcaagacaagatttgcatgacagcatccaactccatgcaaaatcctttgtgagtaaccatacagcttccaccatgacacctgaattatgctaaaacaaaaaaccaaactgaatgtgacctgaaatgcaagtacatcagaacatatctgcaatacccaagccacagggaagaacttgcaaaacaacacagcttttcagttctgctctatcttactgctatggggaattcacttcttcaaagcaggacctatttggagcattacgatccacgattattgatgttgacatgtccatgtagtaatttttcttcaagtctgtaaatcttaaaatatcaaatttctgtgacatcctataaacatatgcactcaactgtagtcagtacttttacctgtgaacctcaggcacaaaaagattattagcttggagtcaccataaacatttagttttgttgcaacagatactgagtctttatgttcagaggaaatgtaagtgtctttttatattagtaatcacagtttacatgccattttcatatgtttggttatattttagtgggatagatgatatattaccctgtgtaaagaaaatgtaaacataagatcatttttatctctcaagtgtgattactcttcagagtttgaagattaaaatagctattttcttca

SEQ ID NO: 378967 - DNA, 561 bp, Homo sapiens
gagatgaagtctcattgttttgtccaggctggagtgcagtggtgtaatctcagcccactgcaacctccacccaccggggttcaagcaattctcctgcctcagcctcccgagtagctgggattacaggcacctgccaccacacccagctaatttttttttatacttttagtagagaaggggtttcaccatgttggccaggctgatcttgaactcctgatctcaagttatctgcctgccttggcctcccaaagtgctgggattacaggtgtgagccaccacgcctggcctctaacaccaactttagatatggccatggaggacaatggaaaatggtgtagttcttagaaattagaaccaggggacagctacacaggctaaccaagaaatctcctctactgaaatagcaagaatcttggaaattcctacggactgactgtgacatgtttcccattcttccatcttctgaatgacagcttttattgcagttatatttttcctaccacttttgtatactggatgtgagatgaacagaaaacacattagtgaactgtgagggaccat

SEQ ID NO: 378968 - DNA, 363 bp, Homo sapiens
gtcttaccagctcccctgggattgggatttagctcatgaagcatcttccacctctccacatacagctctggccccttcaccttggccagcagcggttctgccaccctgtgtatgtatgcctctgctttcagtgaacacatcccaactgtgttctgcagtgaatttaatttaattccctgggtgatagaagactgtgcattctccccctcccctttcagactgtggagtgatgcttttgacctccattggggcaaactctttcctttctaagcgggcaacatccagagtccctctgtacttcagagtttctacccactatggggtcatcaccctaaacagggtcctgctctctccgggagtggc

SEQ ID NO: 378969 - DNA, 591 bp, Homo sapiens
tgaccccacctcagagcaaccacagctgggcggtgctgttcgacgggcagagcgtgagtgggcagggaggggtcaccctggcaggtgtcggtctggggggccccgcctcacccccctgcctccccagggctgcatctgttaccgccctgaggagcaccaggtctgcttcctccgcctgatggaggacagtgatcgggagaccctgcggctgctggtggatacctccaaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagaggggccccggagacagcggctgatttatctctgcatcgacatctgcttcccgagcaacatctgcgtgtcggtctgcttttattacctcccagactgagcccccgacctggcccagcctggcccgtccccaatccagtgggctggccaggccacctgcaccagggaggacagctgctggcagggactaataaacccttccacctggcaaag

SEQ ID NO: 378970 - DNA, 517 bp, Homo sapiens
tgaccccacctcagagcaaccacagctgggcggtgctgttcgacgggcagagcggctgcatctgttaccgccctgaggagcaccaggtctgcttcctccgcctgatggaggacagtgatcgggagaccctgcggctgctggtggatacctccaaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagaggggccccggagacagcggctgatttatctctgcatcgacatctgcttcccgagcaacatctgcgtgtcggtctgcttttattacctcccagactgagcccccgacctggcccagcctggcccgtccccaatccagtgggctggccaggccacctgcaccagggaggacagctgctggcagggactaataaacccttccacctggcaaag

SEQ ID NO: 378971 - DNA, 701 bp, Homo sapiens
aatatgtcctgagacatacatttttatggtggaaaattggggacaggaaaataacaggaaactgcataggcctctaaatacccaatattctcatggtccaatcatctattgttttactaatcaattggggaccaatctattgtgtgcctcctggaatcaatgctactatgtcagccagtcacttgatccagaaattccagcactgttaattaatctgcagtagataagtaccatctggtaattgcaactcacaggagttgaagtcatagatgcttttaccgaagtctagttcactcatgcttgcctgggacaaatgagcttacctcatttaagctctgaataacatgctcctaccacacccaattcgtatacttgatttttaaaattctgactgcattatagtgcaattttactcattcccaggaataaatacatatataatgaaatatgttctttatatagaaaaatatagattgttggaatggattttgaagtttcacatatgtgttttatttttctgtgtttgcttatatatgcgtgtaatatacacctaaaaggttacaatatacacctaatataatttaatatacaactgaaattatggatctattaatataaaaagaaagaacattagaggagaaataattgaaggtaaaattaactttgaaattactcttaattgattcaatagataactgttc

SEQ ID NO: 378972 - DNA, 497 bp, Homo sapiens
taacgggcagatggtgaaacagtagacgcacggtcgttttaaaagggaacattgtgtcaaaacacacattccccacagggcctgcttccttttccatcatccaaacccaccaactgacattccacaagttggttctgagacagagtctcagggtcatcccctgcactcaggctcattttaacattcaacaacttgataaacatttaaagacttccacatggtgtgctgtaggatctaaactgcattcagaaagagaggacttctttccattacaattagtgaagtcttcatcttgacaaagaaatgggtactatttcaggtcagagtaaacaatctagcatgtattctaaaagggaaagtgaggccgggcgtggtggctcacacctgtaatcccagcactttgggaggctgaggcaggcggatcacgaggtcaggagatcgagaccatcctggctaacatggtgaaaccccgtctctactaaaaatacaaaaaaaaa

SEQ ID NO: 378973 - DNA, 709 bp, Homo sapiens
gctttctttgctcagggatagaatttatcctgaagaatgagtgattgcaagaagcccaccatggccatgtaaaggtgacaaccagtacctggtctagagcctctccaaggatttttgcaactcagccacttctccattctacaagacttcaattcattttcttatgagctagaagagaaatattggtcaactttcataatttattgaggcagctgaggttaggtgggttatgaagaccccaatgattccatgaaagaggggagcaaacttcaagtcttatgactcttatctcatgctgtattcattggttgaagaataggttgcttgttacatggaaacagatgtttacagatatcatcaaagaaatgttgacatcgaaaagactgttacatattttttgctttttggtggctacagcaagattggcagaaatgtcttttacctcatccatcttaagtgagatgatgttgttagctattgtaggcaagctactgcagtttgcttatacacaattgcttcatgagacatttactggaagaaggttgttttgattttcctgtcatttgcacaactattttaagatattctgagtctcatttatgattccttatcagtgattgccattagctacaatttttttttctgttattttctctcctgggctttattggcatttgtataataaagagaagaattggtctctgatatg

SEQ ID NO: 378974 - DNA, 3667 bp, Homo sapiens
gtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctgggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtgccccaccacgcctggctaatttttgtagttttagtagagacggggtttcaccttaccgggctggtctaaaactcctgacctcaagtgatctacctgcctctgcctcccgaagtgcttggattacaggtgtgagccactgtgtccagcctgtaactattatttttttataaagagagattcttattttcttggctttttgatgtatctgttcctgatagataatcattggctagtaactcctagtacactggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaacctttttaaaaagttaaca

SEQ ID NO: 378975 - DNA, 1883 bp, Homo sapiens
gtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcag

SEQ ID NO: 378976 - DNA, 625 bp, Homo sapiens
tatgtgtatttgaatggaactgttggtgaatgtatggacaagcagcaaacacatggtaaatgtgttttgaagtaaaagtactataaattacgagttaagaatagactaacttatttttctaattgttattagcatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggtatttgtgcatttctcatatttgtttaaagggtgaaatttgttagagtagccagcttcatccctgcacattactggaaagcgtagttcacatggcactttattttgcttttctctacatcagaattatttctagattgctagattggggacattattgatgagtaatggggaacaaggactactttatgtaatactctgcatcataacataatgttataatgctttactgcattcaaaataatgtctttcacatactacctgatttgatctaaatcccaagaagtagtagaaccaatcatgtccctgtttggcacctgagaagactgagcgacaaataattt

SEQ ID NO: 378977 - DNA, 3031 bp, Homo sapiens
gtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctgggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtggtggcgagtgcctttaatcctagctactcaggaggctgaggcaggagaatctcttgaacttgggaggcagaggttgcaatgagccaagatcgtgccactgcactccagcttcggtgacagagtgagactcagtctcaaaaaaaaa

SEQ ID NO: 378978 - DNA, 2130 bp, Homo sapiens
ggagcaggccctgaggactcccgcggtgctgtcacaagcagtgctgcctttgggagcccctaacctcctgctttttctctcctcagtgtgggaaaggggtttggtcagccaggggtgtcagcagccctgtcccacacccattgtctacacctaatctggtggcagggaggccacagagtgcagtgattggaactgggtgagagggttagaggcaactgggccctaggccgagtcaagtgcatggaatcctgactgtcagcaattagggatctttctgcttttgggagggaagtacttgttccacgcgtctcactgaatatggcacggaacctgatctgtcccaagtgggagtttaaccaagctagcgggggcccagggccctggcccagtctgacacctacctcctctcccaccttctactcacccagaagactaggagaatctgaaagcagaggtggtgcagcgtcactagctccaggaatccagaaaaacagggatagggcattctgggaggttgaagtgggtggatcacttgagctcaagagttggagatcagtctaggaaacacgatgaaaccccatctacacaaagcaaaaattagcttggcgtggtggcgcgacctgtagtcccagctactcagcaggctgaggtggaggatcgcttgagcctgagaggtccaggctgcagtgagccatgattgtgccactgcactccagcctgggtgatagagtgagaccctgtctcaaaaaaacaaaaccaaaaaaacagagctagggctggggacccctatggccactgaatctgagcccctgggggcagaggaactgagctcccagccctgtggctgccaaggatcctttttccttgagcttgcagggattgagagagagagagtcagcggccctgatgttagcgatgcagactccaggagaagggggcatgctcgcagtttagaggaagtgagcccctcttccacgttccactcccaccatcctcctgggaccccagcctgcatgccccccaaaagatgcttttgcactgattcaacaaagcctaaagatgcaaaggcctaattgaagacctgtgaatggcatgtacggtcctcagttcccagctgaggggccactcgggctccccatattcccctcagcctctccatcttccaacaggggtgtggagtgcatccatggccatgagtattgatctgtcccagcctgtgcattgctccgaggcagttctgagtggatgatgtacagatgggattcctcagctcatttgcgtggttgacgttatggctgctggttttactgccacaactcccaggcccaacctggcttaatgtctaagttttaagccaaaaaagatggggagcagagctttgtggcagggctgggggttggggtccactttagttttgtggcaggatgaaggctgcagtggttttattaatcatgattggcctggccgtagctccaggctgagagggacaggtttgtcagtggtggtcccccagatgtccctgtgcccagccctggcctgtctgccctcaggcccagcaggaggcgctaccacaggctctgactggcgtccctactccctgtaccccagatggacagaaccttcgggtctacagtcggaatatatcattctccccattttaacctgagctgcctgacacacggagggtgtgctgggtaaggggcctagggagccagggttgaatcatggatcctggggaaaggttgcagacacaggaagggttgtcacctctctgtggagccctgctgcttaccacacagcaccttctgcagagactagctctgagggtggcaggggaccccacaggccatggccactccctctctgcacctgtccgtgcctgctgtggaagcctggactgggggaggagattgctaccctgtgagcctgagggagccacgtccagctgtgacctctacctggggctttacagagagttgtttatgggtaacagacaccttgtttcagagggaatgggcatgagctggcaagtgaagcacccccacagcttatcaggaactttttctcatttttaaaccatcatgtcttcatttcacattggaataaagtgaggttttggaaaaaaactgc

SEQ ID NO: 378979 - DNA, 2076 bp, Homo sapiens
ggagcaggccctgaggactcccgcggtgctgtcacaagcagtgctgcctttgggagcccctaacctcctgctttttctctcctcagtgtgggaaaggggtttggtcagccaggggtgtcagcagccctgtcccacacccattgtctacacctaatctggtggcagggaggccacagagtgcagtgattggaactgggtgagagggttagaggcaactgggccctaggccgagtcaagtgcatggaatcctgactgtcagcaattagggatctttctgcttttgggagggaagtacttgttccacgcgtctcactgaatatggcacggaacctgatctgtcccaagtgggagtttaaccaagctagcgggggcccagggccctggcccagtctgacacctacctcctctcccaccttctactcacccagaagactaggagaatctgaaagcagaggtggtgcagcgtcactagctccaggaatccagaaaaacagggatagggcattctgggaggttgaagtgggtggatcacttgagctcaagagttggagatcagtctaggaaacacgatgaaaccccatctacacaaagcaaaaattagcttggcgtggtggcgcgacctgtagtcccagctactcagcaggctgaggtggaggatcgcttgagcctgagaggtccaggctgcagtgagccatgattgtgccactgcactccagcctgggtgatagagtgagaccctgtctcaaaaaaacaaaaccaaaaaaacagagctagggctggggacccctatggccactgaatctgagcccctgggggcagaggaactgagctcccagccctgtggctgccaaggatcctttttccttgagcttgcagggattgagagagagagagtcagcggccctgatgttagcgatgcagactccaggagaagggggcatgctcgcagtttagaggaagtgagcccctcttccacgttccactcccaccatcctcctgggaccccagcctgcatgccccccaaaacctgtgaatggcatgtacggtcctcagttcccagctgaggggccactcgggctccccatattcccctcagcctctccatcttccaacaggggtgtggagtgcatccatggccatgagtattgatctgtcccagcctgtgcattgctccgaggcagttctgagtggatgatgtacagatgggattcctcagctcatttgcgtggttgacgttatggctgctggttttactgccacaactcccaggcccaacctggcttaatgtctaagttttaagccaaaaaagatggggagcagagctttgtggcagggctgggggttggggtccactttagttttgtggcaggatgaaggctgcagtggttttattaatcatgattggcctggccgtagctccaggctgagagggacaggtttgtcagtggtggtcccccagatgtccctgtgcccagccctggcctgtctgccctcaggcccagcaggaggcgctaccacaggctctgactggcgtccctactccctgtaccccagatggacagaaccttcgggtctacagtcggaatatatcattctccccattttaacctgagctgcctgacacacggagggtgtgctgggtaaggggcctagggagccagggttgaatcatggatcctggggaaaggttgcagacacaggaagggttgtcacctctctgtggagccctgctgcttaccacacagcaccttctgcagagactagctctgagggtggcaggggaccccacaggccatggccactccctctctgcacctgtccgtgcctgctgtggaagcctggactgggggaggagattgctaccctgtgagcctgagggagccacgtccagctgtgacctctacctggggctttacagagagttgtttatgggtaacagacaccttgtttcagagggaatgggcatgagctggcaagtgaagcacccccacagcttatcaggaactttttctcatttttaaaccatcatgtcttcatttcacattggaataaagtgaggttttggaaaaaaactgc

SEQ ID NO: 378980 - DNA, 774 bp, Homo sapiens
cagaactataattaagttatatttagtactaaacaattgtctttacacatcacagtagcctctgcggtatctctgtaatatatgtagcacagcacagtttttatttttgaaacagtaactgagaaaatctaaaggtatgtgtgctatttcctccttgctcagaaggcaggaagggatataaatatattttagaaagattgttactcaggagcattatgataaaaagaaaataaaaatgaacagctatgatgtttgtcagtatgagatagatttatatgttctgacttggaaagatgaatcttagaggtattatgtggaaaagcaaattatgtacactatgtataacacagtccttggctggcagtggctcatgcctgtaatcccaacactttaaaaagccaaggtggaggattgcttgaggccaggagttcaagactggcctgggcgacatagcaagaccccacctctacaaaaaattagtcaagtatggtggcacacacccatagtctcagctactcctgtagctgaggcatgaggattatttgagcctaggtgacagaggaagaccctgtctcttaacaacaacaacaacaacaaaaaatcacaatcccatttttgttaaaaagaagattagtgaatacatagaagaaatctggactgagtgtagtggctcatgcctataatcccagcactaaaggaggctggggcaaaagtatcgcttgaggcctggagttcaagaccagcctgggcaacaaagcaaaaccctatcttatt

SEQ ID NO: 378981 - DNA, 304 bp, Homo sapiens
ccatcactttggatctgtttgaaactttcccaaatgcctcattggatggttattctccatgtcatccagagtcaagaagagtaactctgtcctgtccttttcaaatgttctggcctgtgcatgtccactcaaaaaaaataagcaaaaaaataaaacaaacttatcaggcggggcatagtggctcatgcctgtaattccagcactgagaggccaaggtgggaagatcgcttgaggccagggattcaagaccagcctgggcaaaaatagggagatcttgcctctataaaaaataaaaagtaaattg

SEQ ID NO: 378982 - DNA, 5416 bp, Homo sapiens
  misc_feature (5379)..(5379): n is a, c, g, or t
aagccatcttgttcccctctaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgttggtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatcttttataaccaggaagaaatattgggaagnagaattggcgagaaggattaaaagagcgtgtttacag

SEQ ID NO: 378983 - DNA, 5680 bp, Homo sapiens
  misc_feature (5643)..(5643): n is a, c, g, or t
agcggaagtggcttcagagatgcagccctcagtgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgttggtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatcttttataaccaggaagaaatattgggaagnagaattggcgagaaggattaaaagagcgtgtttacag

SEQ ID NO: 378984 - DNA, 1723 bp, Homo sapiens
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgttggtattttatttttaaataataatacacaaaaagggg

SEQ ID NO: 378985 - DNA, 2089 bp, Homo sapiens
  misc_feature (2052)..(2052): n is a, c, g, or t
tgtgatctgtgtagtttggaaaatgggtagctggggggatcatctttaaacaatctttttcatgcttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatcttttataaccaggaagaaatattgggaagnagaattggcgagaaggattaaaagagcgtgtttacag

SEQ ID NO: 378986 - DNA, 874 bp, Homo sapiens
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacagctttgaacagcgatgtcttccacattgttgtctccagcctggttcttccctccgaagctgtccattggacatcctcacctgatccctgctagtgtccctgtgcagattagaaaaaggcaacacctctggacttgctcccttagcccttggctgtgcattgcacaaaacaccatctacacgccaactccaatctttaacgcaacactccacagacaatttacactcagcaagtccaacagtgaaatcatgatttttcctgaccaacgttgctcttttacttctgttgcctttctaagttactggcatcaccatccaaactgaaatcctgatatttatccttagagacctcggttctttacaataaacctcaaattgctaac

SEQ ID NO: 378987 - DNA, 5734 bp, Homo sapiens
  misc_feature (5697)..(5697): n is a, c, g, or t
agcggaagtggcttcagagatgcagccctcagtgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgttggtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatcttttataaccaggaagaaatattgggaagnagaattggcgagaaggattaaaagagcgtgtttacag

SEQ ID NO: 378988 - DNA, 5468 bp, Homo sapiens
  misc_feature (5431)..(5431): n is a, c, g, or t
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgttggtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatcttttataaccaggaagaaatattgggaagnagaattggcgagaaggattaaaagagcgtgtttacag

SEQ ID NO: 378989 - DNA, 2010 bp, Homo sapiens
agcggaagtggcttcagagatgcagccctcagtgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtgagcagctaatacagcattaaaattcattgaaatgttgcacattaatctgaacatcatactttaaacgccacatatcattgcattgctgaagcgagtttttcactcattttaacaaatgcttagctcttggttttggtattacaagcctttctatgtataaatgcctagacattgtagacaaatgtgtagtgatattgtatacagaataataggctttctggaaggtcctactttgctgcacatggttaaaaaagattgttttagtattaatagcacatctgtcttcagaagtttttattgcacattgtctacaattatataattttggaatgcttttgtttatagcaataaaagaatctttagaataaa

SEQ ID NO: 378990 - DNA, 648 bp, Homo sapiens
gatatttgaaaaaatattgcaaaatggaaaatgaggcagagaattaatttcagtaacaaaggactgatacaaactgaccagaaggagaaaaaacaaaacaattgagaaataaagctaaataatatgaataaaaaattcacataagaacacatctgggtagccaaaaaatgtatgaataaatgctcaaactcacttatagataggaaatgcaaattaaagtagcaatgaaggccaggcacggtggctcatgcctgtaatcctagcactttggaaggccaaggcgggtggatcacttgaacccagaagttcgagaccagcctgggcaacgtggggaaaccctgtctctaccaaaaatacaaaaatttgcctgacaaaaatgaaaaaaatctgtaatatatattactgccaggctcattcagtactaggggatatgtgaattggtagagcctttttgaaaaccagtcatacagtgtcttttaatattcaaatatatatacccattagccctgtagggccactcttgagaataagaaaaaagcacctaccagtaaggatatatattcaaggatgtttacaagatcattatttctagtgggaaaaaaaaacccaaaacttaaaaaaagaaaaaaactgaaaataaatgttgac

SEQ ID NO: 378991 - DNA, 1250 bp, Homo sapiens
tgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 378992 - DNA, 468 bp, Homo sapiens
atgatttttacagtatagtttgtaaattcctcgtgacatattttcaatgtatttagctttgtcttgtactccacagtggtaatggtaagtcttaacacaggcttttatttcacatccaatagtagcacccaggccctgtccgaattcggcacgagcattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 378993 - DNA, 388 bp, Homo sapiens
tgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggttgagggggttctttccccgggcggtttggggtattggagtgaggtca

SEQ ID NO: 378994 - DNA, 1276 bp, Homo sapiens
tgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgaaatgatcccgatgggacacttgggggaccctgaggatgtggcagatgtggtcgcattcttggcagtgtatggttcaggaatgctgaatatgggaagcaggggtgcttgtgaccctaataaattccaagtcctcttccctgcca

SEQ ID NO: 378995 - DNA, 938 bp, Homo sapiens
gcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 378996 - DNA, 702 bp, Homo sapiens
gcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtcaggttgagttggacgaggtcagccagccaagtggtatagagaggagaacccctccttgagactcctgactcatcctcagacatgtgcagcagaaactcatcctgggtgatgcccgcacaggacacaacgacagatggtgggcgagaaaaccagcttccg

SEQ ID NO: 378997 - DNA, 1023 bp, Homo sapiens
gcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaagattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 378998 - DNA, 1245 bp, Homo sapiens
gcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggcctgcttttctcgcccaccatctgtcgttgtgtcctgtgcgggcatcacccaggatgagtttctgctgcacatgtctgaggatgactgggacaaagtcatagctgtcaacctcaagggcaccttcctagtcactcaggctgcagcacaagccctggtgtccaatggttgtcgtggttccatcatcaacatcagtagcatcgtaggaaaggtggggaacgtggggcagacaaactatgcagcatccaaggctggagtgattgggctgacccagaccgcagcccgggagcttggacgacatgggatccgctgtaactctgtcctcccagggttcattgcaacacccatgacacagaaagtgccacagaaagtggtggacaaggtaggaggctgtgggtggagggcagaatcattcagagactcaatctctctgggcttcacagagagagagagagagagagagagagaatactgggcacagttcctggcaaacattaaatattcaatgaatgtatgagaaatgaagacaaaaaagggtcacagactcagtcttcaaaaaaatccataaaagaagctttcacccacatgagtatttccttacagaattactgaaatgatcccgatgggacacttgggggaccctgaggatgtggcagatgtggtcgcattcttggcatctgaagatagtggatacatcacagggacctcagtggaagtcactggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgcca

SEQ ID NO: 378999 - DNA, 1174 bp, Homo sapiens
cctaagtaactttgagaggacaagataggcaaagttttttccctacatctcttttggccaaaagaatatctgaccatcacagagatccagagaacagaaacaagagcccctaagtcccagcctctgcaatacacagttaccagatgggaatgcagcacagtggcacagagaggtaactacggagcccatgccctggaggaactctgtagctgtgcatcatggaacgccacaggatttttacattagttgaatatgttcctgcatttcagcagtgcataatcgagcaggaggctggaatctggagacctttgttattcattctttttaaggttattttttattaactgtgcatatgaaatttccactcaatttaaaaatccaaatctttttaagcttcttggaagaatttcctcctgcttatattgttaattgcactaatgaactcttctagggtaaattctggcaaactaccctttttttttttttaatcacagaatattcctgttcccacagaactttggcacattctgaagaaaatctctgcagtcaatttttatctcctctgcttgactgcatctaactgttcatctctgttataaatggagcttcagccctctgggtcagagactgacaaccctccttcttcttcctaacctgtcctactctccttctttttctgctttcattttaattttgggaaattttaaagtaaaagtttcaaagttgaaagattatagtgagtacccttatgtcctttagtgcatcagttgttaatgttttgccttgttttcttttcttccttttttttttttaagagaaggggtctctccctattttacccaagctggccttgaaccccttgcctcaagtgagcttcaaccttagcctcctgagtagccaggactatggcatgtaccaccgcacctgcctcacattttctttctcactgtaaatacacattcttattcttgaaccttctgaaaataagttgcagacatcatgaaaatgtaaaatacttcatcatattctttcttttaataagagcattgtcctataaatctgcaatattttcacgcccatgaaactgaacactgatactgcataaatctaatatatgatccatattcaaaattctccagttgtccccaaaatatcctttatagctgtttatttt

SEQ ID NO: 379000 - DNA, 991 bp, Homo sapiens
tcacctcttaacagaagcccaccctccatccctgacaccatgacccactgttgctccccttgctgtcagcctacctgctgcaggaccacctgctggcagcccaccactgtgaccacctgcagcagcacaccctgctgccagccctcctgctgtgtttccagctgctgccagccttgctgccacccaacttgctgtcaaaacacctgctgtaggaccacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaagtgtttgtctgcctggttgcctaaaccagagctgtggctccaactgctgccagccctgctgccgcccagcctgctgtgagaccacctgctgcaggaccacttgtttccagcccacctgtgtgtacagctgctgccagccttcttgctgctaatcaactcccaagagaactaccatcctcacacaacaaccttcagctcaactgacttgtcttttgagggactaatttactttgctgctgacagccaccatgctctcacccaaatttttatgaattctctacatgtttaaaatcttgggaatctgcttgagggagggcagaatacttcatcctcattccctctttccttacaccttgtggatcatgtgccagcttcgtctgttcttaatttggagtcatgatctcagctttgtctcaaaaatcaagagcttcattctttgcttctaaggaatttaggtttctgcaactgatcaatcatctttgcaattatattttcattttaaatatccttctcatggttcttgtatccttctttcttcttttcacgataactttgggttatgtctctggtagcagagattcttacctatatgtttctgaataaactctgaaccatcttcatctc

SEQ ID NO: 379001 - DNA, 4950 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379002 - DNA, 483 bp, Homo sapiens
ggcgcgaattcactagtgattgagccagctcgtgatctccttcttttcagctttgtgttcagaaattaaggatattgatcgaggactccgatcagaactgtgagtcatcccctccccagtgctgtcattttcgtgtccccagctctgtgaagttaggggtcctcctagtgtgaggaggaagtggacacggcatctgcaaccccagctgtctccctgatggatggcactctgcctcagaggcagccctctgccagtgccctgtggcgcccttgcaccccgacctatctgcgtggggtggctgggaaacaccagctcctctgagccccagtcccaggggagatgcagggggcatggcaaaggcccccactggggagatcctggcagttggacagatgccactcactgagcaccttggtccgaaatttctggatatttcagcctctgcatgtttttgcgggggtgcgtgaggctttgcgttgtgag

SEQ ID NO: 379003 - DNA, 604 bp, Homo sapiens
cgccatcttgtccgccatttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccg

SEQ ID NO: 379004 - DNA, 4747 bp, Homo sapiens
cgccatcttgtccgccatttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379005 - DNA, 5100 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379006 - DNA, 5136 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacgggggagctcagtgtgaacactgtcactaccccgaaggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379007 - DNA, 5150 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaagggcgcgtgctcggtcacacactgccttgtgtggccctcctgtccggtgcagcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379008 - DNA, 5050 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379009 - DNA, 5055 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgt

SEQ ID NO: 379010 - DNA, 4289 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379011 - DNA, 5130 bp, Homo sapiens
  misc_feature (5056)..(5056): n is a, c, g, or t
  misc_feature (5062)..(5062): n is a, c, g, or t
  misc_feature (5066)..(5066): n is a, c, g, or t
  misc_feature (5097)..(5098): n is a, c, g, or t
  misc_feature (5100)..(5101): n is a, c, g, or t
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtnggtttncaanttattaacaaccctccgtggttgggacggannanntaaggttcgccaaaataaaacggtttacc

SEQ ID NO: 379012 - DNA, 3740 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379013 - DNA, 2644 bp, Homo sapiens
acgcccagtccttccccgcggccgaggccggcggaggggcagaagcaggaagcagaaagcggcagaagcaggaagcaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379014 - DNA, 4523 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctcagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379015 - DNA, 1460 bp, Homo sapiens
tagcgaaggccctgggcgtcggcagaacttccgggccaaccgacgagaacgatattcctttcctgcggcggataagaattcctgtctttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379016 - DNA, 3940 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatggtgagtggcagccgctcccaggggcagggtgggccagcccacactctttggcatgggatcgcgcggaacccgggcagcccccacagctcccggatgttggtatacccagggcctgtgattcctggcaggggcgttgcttgggcagcacctctggcttggggtaaggttggagacatgccctgagacttggactggcaggagggtccccgccatgcactcaaagagcagccataggaggcgcttggcctgcggctagggggcgcccctctccgtgccttcctgtgcctgtgggacccctgctgcctctgtggtcattaagagacaggtggctgtgcctgttccctgtggcgggcccgcctgccctgctaacactggccatgccctgcagacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaaggtatgcagggctcca

SEQ ID NO: 379017 - DNA, 1515 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccaggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379018 - DNA, 2159 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtctttgtgcattgctgctatgaactttgacctgagtcgggggagaggatggcagagactttatt

SEQ ID NO: 379019 - DNA, 2513 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatctttgtacgtaattaaaaatattgtggcaggattaata

SEQ ID NO: 379020 - DNA, 965 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgt

SEQ ID NO: 379021 - DNA, 459 bp, Homo sapiens
agtagagacggggtttcaccctgttagccaggatggtctcaatatcctgacctggtgatctgcctgcctcagcctcctaaagtgctgggattacaggcgtgagccaccgcacccggccattttttgtatttttagtagagacagggtttcaccgtgttgaccaggctggttttgaactcctgacctcaggtgatccacccaccttggcctcccaaaatgctgggatcacagacttgagccaccgtgcctagcccctgcacacacttttaaaatatccatcttttttccttacacagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtct

SEQ ID NO: 379022 - DNA, 457 bp, Homo sapiens
tcctccctctggcccgtttccccgtgggaggacgagacaaagggctcgtccagggtcccccatgctgctgctcgtctcgtaactatttcaaggagccgattcgccaagggttggtaggggaatgtagccagtacccgtaagcgccagttaaccaattgcagacattgagtctctttttagtgcctgttactaacttgtccctgtagcttttaaatgtcagagtcgtttgtcaaaagaagaaattaaaggccccaggggtacgtattgggtggtttgctgacagtgaatgagtctgttccagcaccgtgtgctgggagggagcgcttgatgccgcggctcaaaacctttctctctgctttggcttgtgagtgcaatttcctgtgcgtcccttaacagttacagatgttgggatacgacatcagctgggccgccttcaacatcatagaagtgatgagtg

SEQ ID NO: 379023 - DNA, 481 bp, Homo sapiens
ttacagatgttgggatacgacatcagctgggccgccttcaacatcatagaagtgatgagtgcctccaagttcaccttcaaggtgaggttctgggacggcaaggctggtggggtggggagtgattacaggtgtgaggcaccgtgactggccaatttttattattattattcttgagacagagtctagctctgttacccaaggtggattcagtggcctgtaatcccagcactttgggaggctgagacaggcggatcacctgaggttgggagttggagaccaggctggccaacatggtgaaaccccatctctactaaaaatacaaaatttagtggggcgtggtggcgcacgcggctataatcctagctacttgggaggctcagacaggagaattgcttgaacccgggaggtggaagttgcagtgagctgagatcgtgccattgcactccagcctgggcaacagagcgagactttgtctccaaga

SEQ ID NO: 379024 - DNA, 676 bp, Homo sapiens
cttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggcaatttccacatgggtcttctgcctggcctgggtcatgcagcgctgcaggactggagcctctgcacctcagctcacgggcccttgggagggggcctcggtccccagcaccatccaggcctggggctcgggcagtcacaggccagggagtcccccaccccgtggtggcctcggtccccagcatctccacccaaggccgtgcaggggagcaggtgcctgctttccctccccttccccaggagcccccggggcaggggcagatccagaattgagaaccgcggaagagcagccaccccacccctgggtgaatttgcctcctttacaccagccttacaccttgaagacgggagc

SEQ ID NO: 379025 - DNA, 4634 bp, Homo sapiens
ccttcaacatcatagaaggcggccagctgatgtcgtatcccaacatctgtaaatacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379026 - DNA, 5210 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccggcctcctgaagctgtggccaagggcagcccaagaaggtggcccctgctctgggggtggggctgcagccatgcaatgtccgggaagcctaacactgcccgctctgttgcagttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379027 - DNA, 5075 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379028 - DNA, 5395 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggcaaaaaaaaaaaaaaaaaaaaaaaaaaaaaaaaaaaaaccgggcagatcaatatgtgccgcgggcgcggcgcaacaagagcgcgttaaggaatgtgcgcagtgggggtcacagcgttggttccactgatccccggctttctgtgaccagggggggacaccccggggggcccccataaggggggcgcgaaatacgaaaacccgggtccctggattcttctcgtaagcaacacaacacacccagacatgactgaattcgatatcagacacacaacctcacgcacgccagacgccagccg

SEQ ID NO: 379029 - DNA, 5167 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggcagctataaatatatattttttttgtaaaaacctccatgggggggcccggtcccaaattcgcccttatg

SEQ ID NO: 379030 - DNA, 2943 bp, Homo sapiens
tgtgcgtctactactaggatgcaggagccaatcgtgcgaacggggagtgcaacgtgcacatcgtccgagctgggctgccagcgactacgaggtgtgcattctgaacgatcgagcgcaggcggaggtaccggaaggtacaaacttggttctcatcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379031 - DNA, 2642 bp, Homo sapiens
ttctcaccaggtggaggccaaaaaggaagttggaatgggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379032 - DNA, 4580 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379033 - DNA, 2504 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 379034 - DNA, 3596 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagctgaggacctggacttctggctgtctaccaccctgggattcctgaggcccgatggacaagggacctcaaagatggaaaagagatcgacgcgctcgacaagagcactgagagagagcacggcgtaaggaacgaaggctctcacggcagcaggagaccgctgaatgacctggacgtctctgaacttgggcaacaccggcgctagcgacaatgacgacatcatagagtggaaacccaagccacacaacaaagaaccgaacggatgggggacacacacgggatcggggaatatgcctacacggcagccctcatgccgcagacgcgagcagccaaccacacaagaaagggaaagacaaaaacgagaggccaactagaaacgtcaggcacaagcgcgcccggaacagaggagaccacacacacacatgcccgagataggcgagaatagaaagcaccaagatcccgagaaaacgcaagccagtcggaggaaggagggcagcacgacaaggcagacgcgcgggcaactcacacgttacatcatccgccaagagagacaagggtggcgcaagctccatgatagagcacgaacgaccgcacgaagagtacgcagcaacaccagggacagtagccgccgagtacgccataagagtggaggcaggacagagatatagtcgagaaaccagcgagggcga

SEQ ID NO: 379035 - DNA, 2800 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaatactaattatccattccttttgggccctgcagcatgtcatgctcccagaatttcagcttcagcttaacctgacagatgttaaaagctttcgtggttaagatggtgtcactgtggggatcatgtcttttccatgtgtacctgtaatatttttccatcatatttcaaagtaacgtcattaacgtcaaaaccaagaaaaacacacacaacatcggaaaccacacacacacacgaaaaga

SEQ ID NO: 379036 - DNA, 1267 bp, Homo sapiens
ccaagcctgagtgttaatttaactctatgttgtccgccgtgtaaacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgacggttgcgtccgggggaggggaaggaagggccgctgtcgccaaggttttctctcccagaaccccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagcttggtgttcagaaattaaggatatggatgctggacgacgggtaccgagctc

SEQ ID NO: 379037 - DNA, 307 bp, Homo sapiens
aactacctgtccctggccccgctctttttcaagctgatgacgtcctccaccaacaactgggtcctcatcaagatcatcaagctggcaagtactgcccgggaatgtggcctcctcaccctgtgtggggcattccctcaccctgtgtggggcattccctgcgggtgaccgaggccccccctgtccctcaccctgcgtggggcattccctgcgggtgaccgaggccctgctgtccccacagttcggtgctcttactcctttggaaccgcggctgggcaagaagctgatcgagcccctcaccaatctcatc

SEQ ID NO: 379038 - DNA, 217 bp, Homo sapiens
atttcgctcctgctgctcctggtgacccaggcgtcggatgtgccacccagggcatcctggccacggcccctttctctcactttccaggacttgagcagccccagccagtacgacacaggtgttgcactgacgggtctgtcctgcttcgtcaccccagaccttgccagagacctggcaaatgacatcatgacactggtgagtttgtaagcctgcccac

SEQ ID NO: 379039 - DNA, 316 bp, Homo sapiens
gtgagttaagcaggaaagtgacatatcctagtttacattttttgaaaagtcattttcattgctatgtggagcatggataggagaggtaagagttgaaagctgggagtcagcttcaggagacaattgtagaagtccaagtagggggatagtggtggtggtagaaaagaataaaaattaatgaattcattgaatgcaaaatcacaaaaatataagtcagagctcatacttcttgtttttctctctagtaatgtttagagttataataacatcatactgattatatttaatttataaaataatttccaaattttccaat

SEQ ID NO: 379040 - DNA, 360 bp, Homo sapiens
gcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatacttta

SEQ ID NO: 379041 - DNA, 3966 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379042 - DNA, 1002 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgtgagcacagccctggaggggaggagggagacaggggagggctggagaccctggcttcatgattaggatgcttccttccttagaagaaacgttcttgttggcaaaggattttaatgcttcagaactgatgattatccactgaactagcagtgcgaatctcttactcctaatttctgttttataagcagaagtcggatatgttggaggaacacaacatcccacaaaatcaaatagagctactagtagaatgggagctggaaggtgtccttgaagagtccattgtcaagttgactccatcctggtcccacaatacctttgtttttctccacactcattccatcctattgtgaggaggggtaaaaagagagagtgatactttatgtctcctgtcagccacccaaaaagacaaagctaagccattttttgtgggagaataactcattttcaagtccccaaccctatgggcatctcacggcacatggatcatttcagga

SEQ ID NO: 379043 - DNA, 602 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgtggataccaatattctattttgcagatagaatttggcccagagaggttaactaatatatccatgatcacacagctaataaaagtcagagctca

SEQ ID NO: 379044 - DNA, 3614 bp, Homo sapiens
gtacccttcatatccagggctttcatgcctattttgcatagaccttttcaattaagccttccagcaaccttggagggagctattagtcatactttacagaggaaggatgtgaggttcagagagagaagatgacctacccaagatcacacagctcacgaaaggcagagcaggttctagacgacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379045 - DNA, 1219 bp, Homo sapiens
  misc_feature (17)..(17): n is a, c, g, or t
  misc_feature (42)..(42): n is a, c, g, or t
ttccatgtgtccctgcnctagctccttcccctgcacctgacncctcccatccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379046 - DNA, 4135 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctcaggtctgttttgtttgttggttttgttttgagcccaggtcttcaggccatagaactgcttctcattaacagctccccttccttccctcactgaaataaggctgtgacggtgctgcaggaaagcactggacgctcacctgaacccaaacaacctgcctccaaatcttaagg

SEQ ID NO: 379047 - DNA, 3029 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379048 - DNA, 2008 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcag

SEQ ID NO: 379049 - DNA, 3864 bp, Homo sapiens
taaagacaggatcagtgttagtatttctccttttgcctcaggttccaatgtgcttggcagggcactgcttggaagcagtccttctaaatcacccatgataggaaagggcaattctgggtctgagaatactccataaaaggaactgccacaacctttgcaggtatttgtttggttgtctcacaaccctgaggccttgagtctgatgtcatcccatttctgcagcttaaacctgagtccctcttttgctgccctcaatggagacatccaccccactctcccaaacagcacaactgtccttcagaggctcaagggcagttatgtaagcgctcccccacacatccccatactcattcctctccctctgtagccagcttttcatgattatttttcttttctgaattcttaggaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379050 - DNA, 2008 bp, Homo sapiens
tctcgggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcacctggctcctgatgggaggacctgtgtagatgttgatgaatgtgctacaggaagagcctgatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagccccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379051 - DNA, 2188 bp, Homo sapiens
gttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 379052 - DNA, 447 bp, Homo sapiens
ctgaagaattcactctcaccagctacccagaggaagatgggagacaaagtcctccctgcccaggagaagaactcccgtgaccagctattggctgccatccgctccagcaacctcaagcagctcaagataagtagttgtgggcatgagccaacagggcggggctgggtagggcctggaggagagggtaggactgcaaaagggaaggcatgcagaggagcttatgtcggctgcagatgatatagactcccagggcccataggggacttcaggtcatctcatgcatcctcctgcctgcaggcaggtcacacctgtatatcccctagagctgagactctacccttcctttaaggagcttcctttaatacctcactccatgcttctctttcattctgcaatgaagcctgtttctccttaaaatggagaaatggcctctacagagtagttttg

SEQ ID NO: 379053 - DNA, 267 bp, Homo sapiens
cctccttttagagcatgaagagctctttatttttcaagccaccaaataatacaagctggcatctagaaaagacccaaatgcgaagattcaaaataaataaatacatcatgagaaaggaaaaactaagacaggaaagtaaacacagatcgagaaaggcattactataagaagcacaagccggtagaccctaggtattttccaagcaggctctgagcttcctaagggtcaacacaaagaggaaacagtcatcagttgcagaatcacaat

SEQ ID NO: 379054 - DNA, 1217 bp, Homo sapiens
ccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagcccaaggcgggtgctggaacccagacggaacagtgttgggggcaggaaggtggatgcttgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 379055 - DNA, 855 bp, Homo sapiens
ccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagcccaaggcgggtgctggaacccagacggaacagtgttggcctacctggcctaaaaaaaaacctcgtgccg

SEQ ID NO: 379056 - DNA, 978 bp, Homo sapiens
  misc_feature (11)..(11): n is a, c, g, or t
  misc_feature (22)..(22): n is a, c, g, or t
ctcgtgcaatntcggcagaggncgtcgcgatggaggagagcgggtacgagtcggtgctctgtgtcaagcctgacgtccacgtctaccgtatccctccgcgggctaccaaccgtggctacaggggagctctttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagcccaaggcgggtgctggaacccagacggaacagtgttgggggcaggaaggtggatgcttgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 379057 - DNA, 320 bp, Homo sapiens
gttttaacactgtgaggtcaacaataatattatccccatgttacagttgaggaaattgatgctcagggggctaaatgaactgccaggctcacatagcatccctagttcagagtgatgtgcctgaggcacggcaggagggcaatagtgagatttctaggcatgagtagctttccttgtcgtttttagcaaaaccaggtgccaccagattggtaatcaaatttagtaccctgactattcctactgggatttggttctccatccctatgagcttgaaattccttcagcgcgtctttagttgttgcaaatcctagcacattggt

SEQ ID NO: 379058 - DNA, 856 bp, Homo sapiens
gctttgtatggcctgggataggagaatattcagaactggttgcctccatattcgtcactgctgtgtctgcagaatgatgaattgcctttgtatctctggaggcttcataagtggataacgcctcacctgctgtactgctcaaattgggaggtaaacttgtgccaggttccaagcttatcctcgacatgtctgtggtcttccccaggccagaggtctcagacaagaaaactgaggtcacaggtggagtagaggagggactgtgcccttgtgatgtcaacaaaatattggaaggcgaggttgtagcatggataggtaccagggaagaggaagagctggtttcttccacagagggagggcttggctgtgatgtatcctcaggacctttgctaaagagagtggtcttctctgagtatgtaaatctctgagtcgtagccagtggagtccctgtccaggaggctgtggctgatgtatccaaagtaggtgcacttagtgatgtagcgccaggtggacttgtttgcatagcaaggatcattcctccagattctgtcatggcaggaaagttagacagcctggtgatggcttctgaggggctgtctgacgacctcatagactgggcaaggaatgagctggatattctcttagaggaggtaatttctgttctaggccccttggtgatcgcagtggaacctggggaagagataatacttgtttgtgtggttgagctggtgtccatgtaagggctgacgtccctcagttcaatagtcaagaaggaattaggctctgttctagcccttgtagactctggccatgtggttgttgacatagaaactattgcttgttccctggtggaggttgt

SEQ ID NO: 379059 - DNA, 1379 bp, Homo sapiens
gcctccagctttgttctttttgcttaggattgcctttgctattcaggctcttttttggttccatatgaattttaaaatagttttttctagttctgtgaagaatgttgttggtagtttgataggaataacattgaatgtgtaaattgcttatgttttcccatttgtttgtgtcatctctgatttctttgaagagtgtttttaattcttgttgtagagatctttctagagtattcctaggtgttttattctttttgtggcagttgtgaatgggattatgtttctgatttggctcttggcttaactgttggtatatgggaatgctagtggtttttgtatgttgcttttgtatcctgagacttcgctgaatttatgtatcagcttaaggagcttttgggctgagactatggggttttctagatatagaatcatgttgtctgcaaacagagggtagtttgacttcctctctttttatttggaggcactttatttctttctcttgactgattgctctggccagggcttccaatattatgttgaataggagtggtgagagagggcatccttgtcttttgccagttttcaaggggaatgcttccagcttttgcccattcagtattatgttggctgtggatttgtcatcgatggctcttaatattttgaggtatgttcattcaatatgtagtttactgagaatttttaacatgaagcagtgttgaattttattgaaagccttttcagcatctattgagataatcatgtgttttttgtctttagttgtttatgtgatgaatcacatttattgctttgcctgtgttgaaccaaccttgcatcccagggataaagcctacttgatcatgatgggtaagctttttgatgtgctagtgggtttgttttgccagtattttattgaggatttttgcatagatgttcatcaaggatattggccttattttttcattgtgtctctgccaggtttcggtataaggaggatgctagcctcatagaatgagttggggaagaatccctcctcctcaattttttggactagttacagtgggaatggtaccagctctttgtacgtctggtagaatttggatttggctgtaaatctgtctggtcctgggcttttcttggttggtaggctatttattgctgattcaatttcagagttcattattggtctcttcagggattctgtttctttctggttcactcttgggagggtgtatgtgtccaggaatttatccatttcttttggattttatagttcctgtcgcttgccctttcagtggactatttttgtttttttaaatggaatgcttcacaaatatgccccttccttgcacagaggccatgctaatttgtgaagcattccattt

SEQ ID NO: 379060 - DNA, 644 bp, Homo sapiens
cggacatggtgtcttccataggtatgacagccggggttggtgcttgagacctctggtcagagcctgtaatgccacgtcatgaattgccacaaacttagcagcttaaaaaaacaaatgtattaatatctcacagtttctgtgggtcggggtctggtagggtgttgttaggttctctgctcaggacctcttcaggccaaaatcaaggtgtcagccagctgagctctcttcaggaggctctgggaagaatccagaatgggcatccaggctcatcaggctgttggcagaattcagttccttgcaattgtagggctgaggtcccatttccttgccggctgtaaactggaggctcctagaggtcccctccatcttcaggaacgagccttgaatctgcctcctgctctccagcctctgatttcctgggcccaggtttagagagggctcatgtgattggctcaggccccctaccttaaggtcaggtgacttgggactttacctctccagaatcactgcacagcaacacctagattcgtgttcgattgaatgactgggggaaggtgtatccaacgggttggaatcgtgtcacactgtggaggaggggccaggggtacgaatccacgggcacacaggtggatgtaggcggtcgc

SEQ ID NO: 379061 - DNA, 389 bp, Homo sapiens
atagcttgtgctcaatcatttctagctgacatcctggcattcacagaggcaaagtccacacacaaaatttcctgggaggaatcctctggttcactgtcatcatcattagggaactctgttgaacagctactcagctctgtgctgactggtagagacaagaagagaagcaattcctgatctctgccctcaaaaaaactaattatttaaaggtaaagagggaaatgaagaaacatgtggcaaaggctgagtggtgtaggaagtgtaggaattctagagagtacagtgcctggtgacagggtgagctgtgaaaagagcaggaactgagttccaagaggggaaggaagggatggattccagaggcattgtcgaggaaaatccagtagtatctg

SEQ ID NO: 379062 - DNA, 869 bp, Homo sapiens
gctgactcctgcccagcagtatgtcttatggcacgaaggttatgcagtgccacaggccgggggctgtcccagacctctgtcttcagttatgtggttcctctgctcagggcctgagattccactttgttatattcagatccatcagctgagaaatttttcaacagaatgtttaactggtttttaagatttaatctctcagtagcattacggaacaaactctttagattcaaactggggcccgagatcaggcccccctcaactgaagcatcgggacactaaattttttcaaatcgacccctttttcttctgggaatactagagacatccccacagccctctgttgcttccttctcccttggcctcccccttcttccctctcttcttccttccctctgcctgtcttctactcttctccctttcccaattttcctctctgccaaaaaagtatataatccaaggctgggttgtatgggaacttgatttccctaattacggtggcttttgggttctataccagcactgttccatgtaaatataatgcaagccacatgtgcagtgtaagttttactagtagccgtacttaaaaagttaaagctgtggctgggcatggtggctcacacttgtgattccagcactttgggaggccaaggtacgaggctcacttgagcccaggagttcgaggctgcagtgagccatggtcatgctactgaactccagtctaggcaacagggagacccttaaaaaaaaattaaagccaggtgtagtggcatatgcctataatcccagctgcttgggaggttgaggggaaggattgtttgagcccaggagtttgggtctagcctccgcaacataacgagatgcaagctctt

SEQ ID NO: 379063 - DNA, 282 bp, Homo sapiens
tcagctctcatactgtagacaagtgtcctatttctggtctatctactgccgcgttttctgcatttttgtgctctttgttggtgagtttactgtttaaaatggcccccaagtgtaatgctgataatgctgaaatgctgtcatgttgctaagggcaagaaggctgtgatgtgccttacagagaaaagacatgtattacgtaagctcctaatcttgagtacggtaccactggctgtgagttcaatattaatgcatcaacaatgtacattcaataaggcagtggct

SEQ ID NO: 379064 - DNA, 1081 bp, Homo sapiens
cctgaactaagacgttggcattgggaacagaaagaaggataccacagtaataaaatttacccttcctacttaacctgtgtatttttaatccatttagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagatggaggtgacacgagcagtgatgaggataaagaagaacatgaaactcctgtggaagtagaactcatgactcaggttgaccacgaggatatcactcttcagagtggcagagatgaactaaatgaggagctcattcaggaagaaagctctgaagacgaaggagaatatgaagaggttagaaaagatcaggattctgttggtgaaatgaaggatgaacggggaagagacacttaaacttactcctgatactaccccctcgacttgtctcaccttcaacccccaaggtccatccagatataggcttcaacagaggtatcttctaattctcgtgacagtaaatcacagagccggagcacatctcccggctctaggacaggccgccaaattgaacaagaatcacacgttacaactgactccctgagtgtaagacgccccccgagtgaatcc

SEQ ID NO: 379065 - DNA, 872 bp, Homo sapiens
ctttctccttatggtttaatgatgtggaattttcattttacattatagctgacatttttatttttatatgttcggaacaggaagagcaagatctggatcaacagggaaatgaggtatgattttatgttggggttcctactacaacactgtgattacaattcagttcccagaatgtttgaaacacaacttattaaaacttagaaacctaagacaagactgcaggctacgaagtcaaactttcggggtcttaatcccaactctgctatatgtaactgtacaaacttggaaacattctttgtgcctcagtttcctcatctgaagaatggggataatgtccctacccaggagagggttgttttgataactaatgtatgtaaagggcatttagaaaagtttatggcacatagcaaacactcaaatattaattatacttcagcaccaagcattctgtcctaaatctaagtttattcatattgtaaaataaatgggggcaatctcacaggcagcacagcaaataagaactctgggatttctccttaataatgggtaagagagaaggctgttctagcccagggtttctcaactttggcactattaacattaggggttggttaattctttgttgtggggtctgtcccattcattataaaatgtttagcgacatcctcggcctttacccactagatctcagtagcagcccctacctattccttctcacccctcatcgtgtcaacgacgagaaatagtggtatagccaaggtattagtcccatttccatgtgataggacttaaatctatttgtggttattattgcatcattttaatccacagcaggtttctgcaactcaggtaatatccaatagtttttttcc

SEQ ID NO: 379066 - DNA, 454 bp, Homo sapiens
  misc_feature (399)..(400): n is a, c, g, or t
  misc_feature (415)..(415): n is a, c, g, or t
ggttataaacatgaaatcactatctctaattttcttgaacgcaacattatttcgtaagcactttcctgtttttctacatagttgtttagccacggttaattgacacttgattggcactccttttttcctttttttcccccaccattagatattgaaaaagtacttgtttctctgcagaaagcagaagactatatgaaaacaacatccaacttcagtgggaaggtagcaccatgtatacttactatatattgttgtgatttatttgggttttcagaaattaaacgttcattaaaggatcattatatatacattttattttaatttggaaaattgttatctgtaatatgcttattccaggatagtttttttgttttgttttttgagacagcctgagcaacnnagtgagacccccatntcaaaaaaccccacaaaaacaagtatcaccactctcaaa

SEQ ID NO: 379067 - DNA, 4662 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatgactcagcttaatcatttctattcatttgtagaccttcaggtttgatcttaattttttccttgtaatctgattcagttctgtaccattttaatttccacctttagtaattaattaccaatatagcacgttagagtatcttaacctataataccagaagcgcattttaggcttaccactaaagactctaacccacttttcctctgtctcttaacagaatggaaaatgatgtcatcattatttccattccttcatgagctataaaacctattaattaaaaaaaaactttttaattgactggacagcacctgcctgtattcagcatgaccacttgctccagcccctacactgaagcattaaggtcaaagtactgaacagttgttggtccctccacactttgtttttccagcttcgtcataatgtgaatattaatgtttaaaaaaaaaacctttattatattgtatttacaacactaggttacataactatagactactcttgccattaaaaaaaaaatctataatgttttcaaaaaatgactt

SEQ ID NO: 379068 - DNA, 4595 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagagatggggtttcaccgtgttaggcaggattgtctcgatcttctgacctcgcgatccacccgccttggcctcccaaagtgctggattacagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379069 - DNA, 2823 bp, Homo sapiens
tgttgattgaggctcaccatttccctgggactgtataaagtgccttatttacattcttttctttttttttttccccccgagagggagtctcagtctgtcgccaggctggagtgcagtggcacaatctcggctcactgcaacctctgccgcccaggttctagcaattcttctgcctcagcctcccgagtagctaggattacaggcgcctgccaccacgcctggctaatttttgtatttttagtagagacggggtttcaccatcttggccaggctggtcttgtactcctgaccttgtgatccacccacctcggcctcccagagtgctaggattacaggcatgagccactgcacctggcctatttacattattttctattctcacaaccatccttgtcagatgagtggtggcatctcattttacaggtgaggcggtagaccctgttactactattagacagtgttccttttgcagaagaatgagcacctgctatgtgggcgttatataatacgtatttaagtttttatgtgcaaattataataaaagcagcaaaagttatgcaactaattttgctgtcttggtttttggaaatacccaactaaggcagagttgtggttttcattgttgaaagggtagcaatgtccaagaaatttattgtggtaaaggatcttggagatcatttagttcaacctattcatgatacaggttattcttttgtctaagagtaccctttgggaatgatcagacacttttctgttgattttttggagaaatatgggagaaacagtggaatatttttatgacatttttaggaaatcacctggcttggttggtagtcccacactgactttccttatgataattctacagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379070 - DNA, 2689 bp, Homo sapiens
ttgagtcatcatgctgcactcagaaagttttagattttggagcattttggattttcaggtttggggtgctcaccctgtattcttaagtgcacatgaaatattctctggggtagaccataggatagtctataaaacaagcctcagctggatgcggtgactcacacctgtaatcccagcactttgggaggctgaggattacaggcatgagccactgcacctggcctatttacattattttctattctcacaaccatccttgtcagatgagtggtggcatctcattttacaggtgaggcggtagaccctgttactactattagacagtgttccttttgcagaagaatgagcacctgctatgtgggcgttatataatacgtatttaagtttttatgtgcaaattataataaaagcagcaaaagttatgcaactaattttgctgtcttggtttttggaaatacccaactaaggcagagttgtggttttcattgttgaaagggtagcaatgtccaagaaatttattgtggtaaaggatcttggagatcatttagttcaacctattcatgatacaggttattcttttgtctaagagtaccctttgggaatgatcagacacttttctgttgattttttggagaaatatgggagaaacagtggaatatttttatgacatttttaggaaatcacctggcttggttggtagtcccacactgactttccttatgataattctacagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379071 - DNA, 3811 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggtatgattttatgttggggttcctactacaacactgtgattacaattcagttcccagaatgtttgaaacacaacttattaaaacttagaaacctaagacaagactgcaggctacgaagtcaaactttcggggtcttaatcccaactctgctatatgtaactgtacaaacttggaaacattctttgtgcctcagtttcctcatctgaagaatggggataatgtccctacccaggagagggttgttttgataactaatgtatgtaaagggcatttagaaaagtttatggcacatagcaaacactcaaatattaattatacttcagcaccaagcattctgtcctaaatctaagtttattcatattgtaaaataaatgggggcaatctcacaggcagcacagcaaataagaactctgggatttctccttaataatgggtaagagagaaggctgttctagcccagggtttctcaactttggcactattaacattaggggttggttaattctttgttgtggggtctgtcccattcattataaaatgtttagcgacatcctcggcctttacccactagatctcagtagcagcccctacctattccttctcacccctcatcgtgtcaacgaaaactatctctagacattgcccattgtcttctgagggcagaatctccccaggacgagaaatagtggtatagccaaggtattagtcccatttccatgtgataggacttaaatctatttgtggttattattgcatcattttaatccacagcaggtttctgcaactcaggtaatatccaatagtttttttcc

SEQ ID NO: 379072 - DNA, 3087 bp, Homo sapiens
  misc_feature (3085)..(3085): n is a, c, g, or t
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtacaactgaccacacacatgcctagaacacataccacagaccaggatgaagaagaccgtgaaccttatccatgaaagttgcggggtcggcgggtcaaacacacggacgaaccgcaccagcggcacgcacgacaaccaggcgaactgtgaagaaacgggccgaactaaaggggcagagggttcgcacacctagaagaaatcggccgtggtcaccatagctaccactgtcgtgagatccatgggcaggaacgtgggcacacgccaggaaacttgtgttgaggccgacctgaaggctggtgggccagggccacaccgaacaatggagaccgcgggtaggtaacacgtgtcacagaactggggagcgcgggcgagcaacgctgcgcacataaagagngg

SEQ ID NO: 379073 - DNA, 3891 bp, Homo sapiens
  misc_feature (8)..(8): n is a, c, g, or t
  misc_feature (345)..(345): n is a, c, g, or t
ctagatgnctcgaaggaagagcaagatctggatcaagcagggaaatgaggaaaacctatttgattctttgacaggccagccacatcctgaagatgtactactgttgccattccaatatgtgccccttacaccaccatgacaaactacaaatataaagttaaactcacggagacagaaagtagaatggtggctgccaggggctggggagaaaagactatagagagttattaataggttcagagtttcagttttataaaatgaaaataattctgtggataagggtggcaaagatggcacaacaatgtaaatgcactcaataccacagaactgtacacttaaaaagtntcaaaggtggccaggcacagtggctcacgcctgtaatcccagcactttgggaggccgaggcgggtggatcactgaggtcaggagttcaagaccagcctggccaacatggtgaaaccccatctttactgaaaatacaaaaattagctgggcgtggtggcgggcacctgtaatcccagctactcaggaggctgaggcaggagaatcacttgaacccaggaggcggaggttgcagtgagccgagatcgtgccactgcactccagctgggcaacggagcactctgtctcaaaaaaaaagaaaaaaaaataaaattctgtgtatgcaagttgaagtagagactgtgcttttttttccaactagttgtttgtttttttaataaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379074 - DNA, 3745 bp, Homo sapiens
ggaacacaagtgggaaagagggaaatcctcatctttcccagtgggaagttagtaagaatataaaacagaaaaattaagaagtagcaatataaacatattactaagataaataaaggcaaatatcaaaagaatcaactaaaagagctagaagtggtttccttcggagagcaggcaataggagtaaaggtgaggaactggagaactagctgagtgcagaagcgtatgcctgtaatcctagcactttgggaagctgaggcaggcggatcacgaggtcaggagtttgagaccagcctgaccaacatggcgaaaccctgtctctactaaaaatacaaaaattagctgggtgtggtggtgtacgcctgtaatcccagctactcaggaggctgagacaggagaatcacttgaacctaggaggtggaagttgcagtgagcctagatcgcgccactgcagtcccgcctgggcaacagagtgagactctgtctcaaaaaaaaagaaaaaaaaataaaattctgtgtatgcaagttgaagtagagactgtgcttttttttccaactagttgtttgtttttttaataaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379075 - DNA, 3871 bp, Homo sapiens
  misc_feature (8)..(8): n is a, c, g, or t
  misc_feature (345)..(345): n is a, c, g, or t
ctagatgnctcgaaggaagagcaagatctggatcaagcagggaaatgaggaaaacctatttgattctttgacaggccagccacatcctgaagatgtactactgttgccattccaatatgtgccccttacaccaccatgacaaactacaaatataaagttaaactcacggagacagaaagtagaatggtggctgccaggggctggggagaaaagactatagagagttattaataggttcagagtttcagttttataaaatgaaaataattctgtggataagggtggcaaagatggcacaacaatgtaaatgcactcaataccacagaactgtacacttaaaaagtntcaaaggtggccaggcacagtggctcacgcctgtaatcccagcactttgggaggccgaggcgggtggatcactgaggtcaggagttcaagaccagcctggccaacatggtgaaaccccatctttactgaaaatacaaaaattagctgggcgtggtggcgggcacctgtaatcccagctactcaggaggctgaggcaggagaatcacttgaacccaggaggcggaggttgcagtgagccgagatcgtgccactgcactccagctgggcaacggagcactctgtctcaaaaaaaaagaaaaaaaaataaaattctgtgtatgcaagttgaagtagagactgtgcttttttttccaactagttgtttgtttttttaataaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379076 - DNA, 3041 bp, Homo sapiens
acttcgagctttgtaccctgtcgctgtgtctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379077 - DNA, 2784 bp, Homo sapiens
gaggatccccaatgtcgtctcctacctgacgaagagtcagagtacaggatgaagacatggagacactggcaagttgtacaagtgaactcatatcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379078 - DNA, 2066 bp, Homo sapiens
  misc_feature (1734)..(1734): n is a, c, g, or t
  misc_feature (1784)..(1784): n is a, c, g, or t
  misc_feature (2027)..(2027): n is a, c, g, or t
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggttgacctgaaatagtagccagcgcaccctaagggtgaacctacctgaagagggtgcttaacccattacttccctatggaccagcntctcattgaacacctgtcttttagaaaatggattctccgggtaatgtcanagtggatgaaaaacttgaaactaaagatattgaaaaagtacttgtttctctgcagaaagcagaagactatatgaaaacaacatccaacttcagtgggaaggtagcaccatgtatacttactatatattgttgtgatttatttgggttttcagaaattaaacgttcattaaaggatcattatatatacattttattttaatttggaaaattgttatctgtaatatgcttattccaggatagttnttttggtttgtttttcaagactctttctccaaaaaaaaa

SEQ ID NO: 379079 - DNA, 1981 bp, Homo sapiens
tgcagccaatgaaacgaggaccaaagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379080 - DNA, 1897 bp, Homo sapiens
ctagtagagactcccttgtgtttattttcataggtccatccagaaattggcttcaaaagaggaatcttctaattctagtgacagtaaatcacagagccggagacatttgtcagccaaggaaagaagagatggggtttcaccgtgttaggcaggattgtctcgatcttctgacctcgcgatccacccgccttggcctcccaaagtgctggattacagtcaaccaaccggtcaacagatgttttattgaatgcctaagacctgccaatgctatgttggtacaaagactacaaatcccagtgcctggccatcaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379081 - DNA, 1867 bp, Homo sapiens
ttttgagacagggtctctgtcacccaggctggtgtcacccagtgcagtgacaggatcatggctctccacaacgtctacctcctgggctcaggtgatcctccccccctcagtcttctgagtagctgggactacaggcacccactatacccagctaacttttatattttttgtagagatggtgtttctccatgttgcttaggctggtcttgaactcctgggctcaagcgatccacccgcctcagcctgagccttccagagtcctaggattataggcgtgaaccactgctcctgggccttctttctcttaaatgtaactgtaggtaggattttgaaaattattgttctcattacttattatgctaggcaaaaattaagtagtaaagaatatatttaaacattggtcttcaactctttgggaactatgaagcagagtttaagtaccactgttccagcttagatggtatgtatatcaggaaaagataaaaaatatgttgagatactaattcaagtgttttagcattttttgtaaagggcggtataaattgcctttgtaactgttattttccctttttaggaaaacctatttgattctttgacaggccagccacatcctgaagatgtactactgtttgccattccaatatgtgccccttacaccaccatgacaaactacaagtaagttaccattagttgacagaatggcttttgtgaattgttttgtaacatctatttagtaacacatgtaattcctttttaaagatataaagtgaaacttactcctggagtgcagaaaaagggaaaaggtatttaaatttgtttttttgaattatgattttaaacagttcagtgacttaacagtagattattcttactcttttttgtatttacagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379082 - DNA, 1696 bp, Homo sapiens
ttttgagacagggtctctgtcacccaggctggtgtcacccagtgcagtgacaggatcatggctctccacaacgtctacctcctgggctcaggtgatcctccccccctcagtcttctgagtagctgggactacaggcacccactatacccagctaacttttatattttttgtagagatggtgtttctccatgttgcttaggctggtcttgaactcctgggctcaagcgatccacccgcctcagcctgagccttccagagtcctaggattataggcgtgaaccactgctcctgggccttctttctcttaaatgtaactgtaggtaggattttgaaaattattgttctcattacttattatgctaggcaaaaattaagtagtaaagaatatatttaaacattggtcttcaactctttgggaactatgaagcagagtttaagtaccactgttccagcttagatggtatgtatatcaggaaaagataaaaaatatgttgagatactaattcaagtgttttagcattttttgtaaagggcggtataaattgcctttgtaactgttattttccctttttaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379083 - DNA, 1066 bp, Homo sapiens
aagttaactcgtgctatcgtgcagcagaggaactctgctgtggtagctagctcatatgatgttcatgctatgcatggttaccatagcatccactggcaaaagaacgtcgactaattccgtcaacgttctactgacagctaggtctctcaggagacatacctggtaatgggatacgggtctagcggcccaacatgcgtaacttggaaacgatcagaggatacggagaatcatgtgagtgtgatgtgctgagagtattgtgatgaagtaggcgtagttgtgtatagtcctcttatggtaatgattctatagatgaagaggacgctagtgtatcgatgcgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379084 - DNA, 925 bp, Homo sapiens
ctttctccttatggtttaatgatgtggaattttcattttacattatagctgacatttttatttttatatgttcggaacaggaagagcaagatctggatcaacagggaaatgaggtatgattttatgttggggttcctactacaacactgtgattacaattcagttcccagaatgtttgaaacacaacttattaaaacttagaaacctaagacaagactgcaggctacgaagtcaaactttcggggtcttaatcccaactctgctatatgtaactgtacaaacttggaaacattctttgtgcctcagtttcctcatctgaagaatggggataatgtccctacccaggagagggttgttttgataactaatgtatgtaaagggcatttagaaaagtttatggcacatagcaaacactcaaatattaattatacttcagcaccaagcattctgtcctaaatctaagtttattcatattgtaaaataaatgggggcaatctcacaggcagcacagcaaataagaactctgggatttctccttaataatgggtaagagagaaggctgttctagcccagggtttctcaactttggcactattaacattaggggttggttaattctttgttgtggggtctgtcccattcattataaaatgtttagcgacatcctcggcctttacccactagatctcagtagcagcccctacctattccttctcacccctcatcgtgtcaacgaaaactatctctagacattgcccattgtcttctgagggcagaatctccccaggacgagaaatagtggtatagccaaggtattagtcccatttccatgtgataggacttaaatctatttgtggttattattgcatcattttaatccacagcaggtttctgcaactcaggtaatatccaatagtttttttcc

SEQ ID NO: 379085 - DNA, 1267 bp, Homo sapiens
  misc_feature (8)..(8): n is a, c, g, or t
  misc_feature (345)..(345): n is a, c, g, or t
ctagatgnctcgaaggaagagcaagatctggatcaagcagggaaatgaggaaaacctatttgattctttgacaggccagccacatcctgaagatgtactactgttgccattccaatatgtgccccttacaccaccatgacaaactacaaatataaagttaaactcacggagacagaaagtagaatggtggctgccaggggctggggagaaaagactatagagagttattaataggttcagagtttcagttttataaaatgaaaataattctgtggataagggtggcaaagatggcacaacaatgtaaatgcactcaataccacagaactgtacacttaaaaagtntcaaaggtggccaggcacagtggctcacgcctgtaatcccagcactttgggaggccgaggcgggtggatcactgaggtcaggagttcaagaccagcctggccaacatggtgaaaccccatctttactgaaaatacaaaaattagctgggcgtggtggcgggcacctgtaatcccagctactcaggaggctgaggcaggagaatcacttgaacccaggaggcggaggttgcagtgagccgagatcgtgccactgcactccagctgggcaacggagcactctgtctcaaaaaaaaagaaaaaaaaataaaattctgtgtatgcaagttgaagtagagactgtgcttttttttccaactagttgtttgtttttttaataaggcggtggatgaattttattccaagatagaaggccagaaaattgacttaaaagctttacaacaggtatgtattattaaaaacacatattaaaccagctagtctttagcggcttgatgggtagatgatataggaaagggtagcctttcagaaagagtgtaagaagtagtatgggaactctctgacctgcctctttatttatgataaaggtttatgaagaaggtccatgggggattttattgttgaaaagtatgtcctcatttgtttcatgagtatttcagatattctgtaaaaaaaggaaaatacggtgggaacgtgaggcctgttatttacaccttaatgtggtttgctcagaacaacccaaagcttctcaaacattgctgttaaggagatactgttttagggagattttaaataggccagaggaggggatattgtttatcattaaactgtttcttttttaaatggactttaaagccaagtcttaatatgttttctgtgtatcatgactccaaaagaagtgatatacagtattttcccagcacat

SEQ ID NO: 379086 - DNA, 280 bp, Homo sapiens
ttcaagtgattctcctgcttcagcctcccaagtagctgggattataggcacccgccaccatacctggctaacttttgtatttttagtagagatggaatttcaccatgttggccaggctggtctcaaagtcctgacctcaagtgatctgcctgcctcggccttccacagtgctggggttacaggtgtgagccactgtgcctggcctcaaaaattatttgaaagagcgctaaattgtattttattttattgcaggggaacattgttcttacagattatgagt

SEQ ID NO: 379087 - DNA, 490 bp, Homo sapiens
ttgttttgtaacatctatttagtaacacatgtaattcctttttaaagatataaagtgaaacttactcctggagtgcagaaaaagggaaaaggtatttaaatttgtttttttgaattatgattttaaacagttcagtgacttaacagtagattattcttactcttttttgtatttacagctgcaaaaacagccttgaatagtttcatgcattccaaagaagcaacagcaagagaaaaagacttattccgcagcgtaaaggtaaagttctccttcagaaaaggaatgtggagactgacagtacaatttaaaatgttagcagttttttgttattttagtagaaaatgctgtcttattagaagcagtaaaaccatctcagctaaaagtttggaaatgtttttcgtttttgtcataaaagaaacatgattgaccatacaggatgtgaagatattcagcaattttctttttttaggacacagatttatcaagaaac

SEQ ID NO: 379088 - DNA, 465 bp, Homo sapiens
ttttgagacagggtctctgtcacccaggctggtgtcacccagtgcagtgacaggatcatggctctccacaacgtctacctcctgggctcaggtgatcctccccccctcagtcttctgagtagctgggactacaggcacccactatacccagctaacttttatattttttgtagagatggtgtttctccatgttgcttaggctggtcttgaactcctgggctcaagcgatccacccgcctcagcctgagccttccagagtcctaggattataggcgtgaaccactgctcctgggccttctttctcttaaatgtaactgtaggtaggattttgaaaattattgttctcattacttattatgctaggcaaaaattaagtagtaaagaatatatttaaacattggtcttcaactctttgggaactatgaagcagagtttaagtaccactgttccagcttagatggtatg

SEQ ID NO: 379089 - DNA, 461 bp, Homo sapiens
agtgctttagctaaccagatagattggacagaaattgggttaattgtgaaagaagcccaggctcaaggagaccctgttgcaagtgcaatcaaagaattaaaactacaaacaaaccatgttacaatgctgctaaggtaagtttgactcttagtcaagcagttaatgcttgtctttattttgttattttaattgttcactgtattaaacattttttcttcatattttgaaattctcaaagaaagggaaaaaactaatttagattaaaataaataatgaaacttccagtactgtaaaccatttataattttattgaagaagaaaattgaaaataaaagtgatgtcattgacgttagtgaaatgctattgaatatttttaatagaaatccatacttgttatcagaggaggaagatgatgatgttgatggtgacgtcaatgttgagaaaaatgaaactgaaccacc

SEQ ID NO: 379090 - DNA, 312 bp, Homo sapiens
ccacggaccttgactgaagctggcacaatggcactttgctacagtgctgcttgggatgcacgagttatcactagtgcttggtgggtgtaccatcatcaggtaataagggctcttgtcctttttcttaatttactaagagctactgtgtgccaaattttgagagtatagaagtaaataaagcagacaaggctcaatagagctaactctttttggtagaggaaaatatgtacataatgtcaggtaataagtgccataaaatagtgtttttaaaagcatggaaggggatagagagtgataggggataccgttttg

SEQ ID NO: 379091 - DNA, 631 bp, Homo sapiens
gtagcaccatgtatacttactatatattgttgtgatttatttgggttttcagaaattaaacgttcattaaaggatcattatatatacattttattttaatttggaaaattgttatctgtaatatgcttattccaggatagtttttttgttttgttttttgagacagtcttgctctgttacccaggctggagtgcagtggcatgatcttggctcattgcaacctctgcttccctggttgaagtgattctcctgtctcagcctcccgagtagctgggactacaggcacgtgccaccatgcctggacagtttttatattttcagtagagatgaggtttcaccgtgttggccaggctggtctcgaactcctgacctcaagtgatccgcctgccttggcctcccaaagtgctgggattatagacatgggccactgcacccggcccaggatagtgttttaaaagtttttgttggtttataagtttttttctgttccctatcttttatagaaagtacaatgtcaggttagtatcggctcttcagaaaagttgaggaatttacagttatttctttagtttcagatagagaagcacattttcatttgtcagcccttttcaaaaatgttgtgatttacagc

SEQ ID NO: 379092 - DNA, 4121 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379093 - DNA, 4216 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtactcttcaacttcttggttatttatttgtttttttcctgattttcattagtcttgtctgaagctccgtcactgaaaaataactgtttctttaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379094 - DNA, 4292 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaagtaagttaccattagttgacagaatggcttttgtgaattgttttgtaacatctatttagtaacacatgtaattcctttttaaagatataaagtgaaacttactcctggagtgcagaaaaagggaaaaggtatttaaatttgtttttttgaattatgattttaaacagttcagtgacttaacagtagattattcttactcttttttgtatttacagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379095 - DNA, 4207 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggtattatgtttggctttctcagtgctttttcaaaaatgttaactttaactggcaatgtagtaaatgtgtgtggtttgttttttaaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379096 - DNA, 3995 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaaggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379097 - DNA, 3447 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataagtgaaactttactcctggaggtgcagaaaaagggaaaagctgaataacagacttgaatagtttcatgcagtcaaagaagcacaagcagagaagaagactattcgcaggttaagacacaggattattagaacattcggaagtgaaaggtttgccacatctctgaagtaagaggattgctgaatgaggttgactcggaaggcgcggtaagcattggagttcagggaaacagggtcggtggttaaaggcaatgtggtgtgcaaggatttgtgcattgtgaagttatagtcattgggagaagagaagacggggggaaggaaaaaggggagagaaaaaagggcaat

SEQ ID NO: 379098 - DNA, 3610 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagagatggggtttcaccgtgttaggcaggattgtctcgatcttctgacctcgcgatccacccgccttggcctcccaaagtgctggattacagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagatggaggtgacacgagcagtgatgaggataaagaagaacatgaaactcctgtggaagtagaactcatgactcaggttgaccacgaggatatcactcttcagagtggcagagatgaactaaatgaggagctcattcaggaagaaagctctgaagacgaaggagaatatgaagaggttagaaaagatcaggattctgttggtgaaatgaaggatgaacggggaagagacacttaaacttactcctgatactaccccctcgacttgtctcaccttcaacccccaaggtccatccagatataggcttcaacagaggtatcttctaattctcgtgacagtaaatcacagagccggagcacatctcccggctctaggacaggccgccaaattgaacaagaatcacacgttacaactgactccctgagtgtaagacgccccccgagtgaatcc

SEQ ID NO: 379099 - DNA, 2750 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagatgtaaaatgaacaacacatgaaaagacaaatacctagagcccgaacgaaccccctgtga

SEQ ID NO: 379100 - DNA, 2410 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtactcttcaacttcttggttatttatttgtttttttcctgattttcattagtcttgtctgaagctccgtcactgaaaaataactgtttctttaggtagatgagtcttgtgtttggagacatcagggtgaacgaaaagtcagagtacaggatgaagacatggagacactggcaagttgtacaagtgaactcatatcagaagaaatggaacaattaggtagtttatagattttaagaaattagcttgtgatgttttttgttacctagttttgcttctaaatccttagaagatcatgtctctttgggataatctaaatttcaaaaaaaccccgaaaacccaaagtacgtgctgttttactgaatttt

SEQ ID NO: 379101 - DNA, 2106 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatctaccttaaaaaggaagctaaaccggcgcggccg

SEQ ID NO: 379102 - DNA, 2644 bp, Homo sapiens
ccccttttaaaagcaccgttttaacctcccagttctggaaaatggttaccgggtatctctatttaagggaaaaaaaattaaataaaacactttgggttttcccaaaaaaaaaaaaaaaaaaagaaagaaaattattgatgtagtggattctttgtttttttctttgttacttccaaaggcttatctgtcattaaaggggtatctttccctttagtattgagaatttgtacgaaattataaacttttcagaagacagtgtggcttacttgactctgactttactttctcctcaagtggaaaaagaaaactagagtatttttttaaataagaatataatgtattattgtgttcttcaggtatctaaaacagcaccaactggagaatatttgacaacaggaagcttcatgataagaggaaaaaagaattttcttcctccctcatatctaatgatggggtttagcttcctttttaaggtactcttcaacttcttggttatttatttgtttttttcctgattttcattagtcttgtctgaagctccgtcactgaaaaataactgtttctttaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379103 - DNA, 2066 bp, Homo sapiens
cctgaactaagacgttggcattgggaacagaaagaaggataccacagtaataaaatttacccttcctacttaacctgtgtatttttaatccatttagtcaaccaaccggtcaacagatgttttattgaatgcctaagacctgccaatgctatgttggtacaaagactacaaatcccagtgcctggccatcaaggtgatcaggggcaaaatgtgcctagtgagtaaggatgagtcaggggtgacaatatgttgagcttggatgatggaaagaaagataaatccatgagagatgaaaaacttgcatctttttcccacatgatgattttaagcatctttgtattttctaacttggtgattatcaagtgaagcagaagccatgaccatttatatactgtatatgtgccttccccatggaacttttttagggcactaagaatttcaaattctaagaatgaaatgttttcatgtcttttttattcagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctca

SEQ ID NO: 379104 - DNA, 1497 bp, Homo sapiens
gcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggtatgtattattaaaaacacatattaaaccagctagtctttagcggcttgatgggtagatgatataggaaagggtagcctttcagaaagagtgtaagaagtagtatgggaactctctgacctgcctctttatttatgataaaggtttatgaagaaggtccatgggggattttattgttgaaaagtatgtcctcatttgtttcatgagtatttcagatattctgtaaaaaaaggaaaatacggtgggaacgtgaggcctgttatttacaccttaatgtggtttgctcagaacaacccaaagcttctcaaacattgctgttaaggagatactgttttagggagattttaaataggccagaggaggggatattgtttatcattaaactgtttcttttttaaatggactttaaagccaagtcttaatatgttttctgtgtatcatgactccaaaagaagtgatatacagtattttcccagcacat

SEQ ID NO: 379105 - DNA, 375 bp, Homo sapiens
aaactgtcctggcaagaacaatcataaaacatgaattaagtatacaaaaaagtttaaaagcatttgagagcaaccaagtagtcaggacttaaaagtctaataataatataaaaaagaacacattgaagggaaactaatattctgtgctactttagcctttgaggtattcttcaaatcctaagcaatgcaaaataacggtataaaaagccaaatagaaattggcaatagagagtccaaaaaactaagaagagtttttagcagacacactgctgatgaaatagaaattgtacttcaaagactgtcaatgtggaggtcctaatccaagcttttagttgagacccctgaagagccaggccttagaagaaagaaaaaact

SEQ ID NO: 379106 - DNA, 408 bp, Homo sapiens
tgaagtattaatagtgatagaaaaacgtaagaagtaaagaataaattacattcaactgtgttgaaaatgctcataatttataaacatgattgctttttcttccctctatgagatgattacaagtggctcaaagcaaaggatgtgaatagaatcaaaatatttaattaattgaccattgaagtgataggggctgatagtagatttcctgtcactaaatgaaagacatagtcaagctgggataaatgtgattggccaaatatctccacgacgtgtatgtccgctttctgtcatgtgtctgtggacactgccggtgatttgaatcaatataacattttttattattgtaaataaaatgcttcatttagttctttctctgacatgaggaaaaattgttctctgatgaactac

SEQ ID NO: 379107 - DNA, 268 bp, Homo sapiens
tctgaaactctttacttacgagaattttttgtacattaatgagttgactttacttgaaatagccatcagaattataattgcagtctcctaaatttaatatttttaaattatttcaaaagaatatgactcacagcaactcaaggaaggaataagtggaaatcttttcttataggcttatatgttgtatacatcaaaaaaataaagtcacttaaagagaaaatgatggggagtcttttgaggcagtgatgttaactgtctttttcacatc

SEQ ID NO: 379108 - DNA, 1213 bp, Homo sapiens
gcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattccta

SEQ ID NO: 379109 - DNA, 313 bp, Homo sapiens
tgaaggggtctgctgtcagcttgagaaactaagaccgaactatgaccaccctatcttcaactggtccagaatagggctttgcaaaaattacgttctttctttctccgttaaccctgattggagaaacctgcccagatcttggctggtttggaagcgggaagtgtcaacaaaagtgaagagtctcacaaagccagtagctcgggagaccccaagagcgggccagaaacgacctttccgttggaaaacgggcccctctcccacctgctgcaggtccccggacccgccctcctgcgcctcgaccacaggcgcggcc

SEQ ID NO: 379110 - DNA, 1102 bp, Homo sapiens
  misc_feature (449)..(450): n is a, c, g, or t
  misc_feature (546)..(546): n is a, c, g, or t
  misc_feature (629)..(629): n is a, c, g, or t
tgaatgataagattaccacttttcagatcattaactttacatataagaaaaattccctgagtaagccattgctgggggaaaaattataaacttttcatgtcatgatactttatttatttccataaaaacttaacatcacttcttgatattttctaattgagagctctttattgaaaaatagcaactttctaaattaagagctccttattgaaaatagcagtttgtgcacacaatagcataacattcttttctgtattttgagaattaagaaaataaatgtttttaaagatatatgccaatagtgatatttaacacataaaggtgtgatgtatttttgaagtgtcttagaagaaagccaatgtggatattgcagggtcactgtggaaatgtgtatcagtgaccgtttagttgtaaatgcacaaaagagaaagaatgtcagccttagaggnntatcctgcttttcccaattttagaaccaggaagtttttactgaaatggctttgtggaacttacttacaagctaagtaaccttcccagtagttttantatggacagtaattagtgctttcgcttttctgatgaagatgtgtaaaaaaaaacaggttaggaatttcctctcccccaccagnctcattctgtggaataagcagaagcaggacgacagccagctggagtctgactgcagggactcgcttcctcaacaccctgacctcacactggctcagcggaaggtctgaactgtgctgaaatgttatagaacaaatgtgaataaagctgtgggtagggaggggagagctagtgggagagatacattctgttgctttaagtgatggccattctttcttatttcttgtttccacaaaacgttttccatttgcctaacaaacttcttaatatatttccataagataattttaatacttttttaaatttataatttgattttgatgtcttttctccctactcccagggaacagaaaatagggtagctgttattgctctggagtgttttgtcacccttccatgacgcctcctctgtgcatttgagttcactgtttatgctcaacactgaatttcaacaaaatgcctcatttggaactta

SEQ ID NO: 379111 - DNA, 385 bp, Homo sapiens
actcccttccggatgtatcccttacgtctcatctcccttaccgtctcatctcccttaccgtctcatctcccttaccatctgcagtccttgtttctccactacacaagaaacacatccaaaacaagcaacaccttttcacagcttgtctctctcaatagtaacaacaacaaactagttatttctcccagctccagtatgaaagttcccagtagaggttcagttcacctatccttcccatggacagatctgcgtggctaggagaaagttctatgactcggcccatctctgaagccaaggggactagggggttgtggggaggtgggtattaatgaagggcagcactgacctagccactaataatcctcctgaacttcgcagcctcccc

SEQ ID NO: 379112 - DNA, 462 bp, Homo sapiens
tcttttactttcaaatgtcaaatacctaaacactaccttaagggtaaggaggcctaataattaatgtagtcagatcataaaaagtatgctctagtagcctcagggatccaggaatttctctctcatctcaattcgcctctttctaccccaaccatctgcagtccttgtttctccactacacaagaaacacatccaaaacaagcaacaccttttcacagcttgtctctctcaatagtaacaacaacaaactagttatttctcccagctccagtatgaaagttcccagtagaggttcagttcacctatccttcccatggacagatctgcgtggctaggagaaagttctatgactcggcccatctctgaagccaaggggactagggggttgtggggaggtgggtattaatgaagggcagcactgacctagccactaataatcctcctgaacttcgcagcctcccc

SEQ ID NO: 379113 - DNA, 425 bp, Homo sapiens
gaacaggatttgaatagtaagtcaagtgcttggtctcctgtactagaagcaacagtagctctcagaagtgtgaattttattttttcaatgtaggtagcttatgaggcagacaggagaatccaaaatgagcaagtactctttggcatgttgaggttgtaactactagtcttttatgtagattttgtttttattagtatgaaaaatacttagtgcagtctgaaaactgtgaggttgatgggtgttattaatagcaaatcaaagtaattttcttatgtgcattaccaataaaaacagggaaatatttgtgtatctttcatgttttgtacttagtaatttttcaaaattctctacccacttaactgtttttccaaaataaaagactcccccccgattgaaaaatattcattgttcttttaaaaaaagaa

SEQ ID NO: 379114 - DNA, 472 bp, Homo sapiens
gagactgcaccactgcactccagcctggcgacagagcgagattccatctcaaaaaaaaaaaacaaaaaaagacatacttttccaattagggtaaacgtgcgattcgcaagggagggtgggggataggagtggtccctctgctacagcacaaggcgtgttcggacatgtctgggcaagtccgggcacaacaagagcgggagggctgctcacaggctagaaacaagaaagtacaaggaggtgaggctccgaaccaaggacaaggacattacacaattaaaccctttgaagacgaattcaccatctctggcagtcagaatgatagagggagacaattgcagatagaacaaggcctttgggagaacggggagttgaagtggaggaggtgatgctggagtactgggaatgttctatttcacgatgagtgtgaattacagtttatggaactgtgagtttatgtttgataacacttctc

SEQ ID NO: 379115 - DNA, 359 bp, Homo sapiens
tttttttttttgagacagggtctcactctgtcgcccaagctggaatgcagtggtacaaaaaatacatttatataaaggtacatataaattaactcttgagaactgtatacaccacaagtgtggggcaaatactgagcttaaattattacctgataaattaaaaatgtaaaaaatacgcaaactaaaatggaatttttaaaggtcatctagtccaacaaccattatagcatatagtttgaatgtaaaacacctttaatagcgccattgtgttatctttaaaaagttgggtctgctatcaactataccaataacaagatatatcagcttagacccacctcagttttcctaggcctttcttt

SEQ ID NO: 379116 - DNA, 1013 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379117 - DNA, 2612 bp, Homo sapiens
agacggatggggtgctggaccaggctggagtgcaatggcgcgatctcagctcactgcagcctccgcctcccgggttcaagcgattcttctgcctcagcctcccgagtaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtaaagggtttggcttccccagtgggtggagtggggggttctaggtggatgcttggctgggtgtgctgtggagaaggagcatgtgcatggctgtagacatgtgtaggtcctcccgccccattctgtctcaacacatatactggctcctgtggtccggggccctctcccagcgtctctgcccgtaattaaccaagcacattaatggtagtttcgttttccctgcgagctggccagtaattgcctctgagagcccttccttccgccagccccatccttactttactggatctcccctgtccctgaagtgtggttggggtcagaagagggactaggactgctgggtcctcagaagagactggttgacaggggtgggtatgtaagagatgcagggcgttctgggaacctgggttctgtttcctagctaaggcgaggttcaaaacagagcctggctccagtgcctgcccgcttttctttcagggctcaggatgagtgactgcccccagtgggggtgcttggcaggtgggggaggggaagaggcttcagggcagaaggctcaatcgcttttattgaccccaactgggtgatgaaaggtgatcaatgatgatcgatggaaatgacagcctgaggcttggggctgagagggcatccagacagcagtggtcagcccatccttgtgcctcctttaaccctggctgcctttctgtctcagaccatctgtctgtccccagtactaaccatcaaaccctgtgtagggctagatatctcaatgtagtccctgtacttatcccaaaggctagttgggctagagggaaacaaattcttctggaccacggttcacaatgaagaactggaaaaagacagacaggctcaaaccatagggccaagaatccttgtctcaggcctttgggtgaaggtaggggtagggggtgcaggctggatcctcatgtaaggtataaagaagtcagttggtccagagcccgggcctcaggtctccagtttgaagcctttcatgtctctctccttcctcacagtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379118 - DNA, 783 bp, Homo sapiens
gaggaagtagggggctgggaatccgggactgtgggggcaagttgacggctcccagggtcgtcggggctgagccgagaggcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379119 - DNA, 735 bp, Homo sapiens
ggacgcgtgggtcgacccacgcgtccgggaacagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379120 - DNA, 1783 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379121 - DNA, 1683 bp, Homo sapiens
gaggaagtagggggctgggaatccgggactgtgggggcaagttgacggctcccagggtcgtcggggctgagccgagagggtggttagaatttctatattttggggtccctccctccgtatgggcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379122 - DNA, 1519 bp, Homo sapiens
tggggtgggggaaaggaaccggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379123 - DNA, 1988 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatatggggtctcattatgtcagccaggctggtcttgaactcctggcctcaagcaattcttctgccttggcctctcaaagtgctgggattacaggcatgagccactgtgcccagcacagaaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379124 - DNA, 3529 bp, Homo sapiens
gttagtataagtaacatgaaaacattctcctccgcataagcctgcgtcagttcagtgttttaatagctggacccagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaatgtaaaacagggatgcctaccttatggggttggtgtgaggattaactgagatcacacttgaaagtgccttgcatgggcttggcatgtgggtgctcattacatagtcttcttgttttcttgcctctgggttgaggattcacagcactgcactacaagggtagcccctctccattctggataccttgctaggagagagtctgggcttccacctgcggccagggtgaagggaaaattcttgccatgtcagagatggatcaatgactatgaaaaaactagcctgtgattttttttcactctaagcattaagagctcctaaagccttttgtcttgttacttttttccccctcttgcatgctagaggtggaaggtagtcatttagatttcccccctcttccctcttcattgttggccaggggttctcttgggcagctgggggaaggatgtagtagatctctcttttttttttttttttgagatggagtctcatgctgttgcccaggctggagtgcagtggcatggtctcagttcactgcaacatctgctttcccggttcaagtgattctcctgcctcagcctcctgtatagctggaattacaggcatgtgccaccacgcctggctaatttttgtatttttattaaagacagtgtttcaccatgttggccaggctggtctcaaactcctgacttcaagtaatccacctgtcttggcctcccaaagtgctgctgcctggctggatgtagcagatctccaattgccttaccaaacctgcagggtctctgttaagtgtctgttaggggtcttatatgatactctggacaccgtgagaaacaggtgatggggcagatgggaacctggtatccaactcattttttatgtctgctgaatggttgactgggtgcccctttggtaagggctgggaaagtgaaccaagttgggagcagagcaggtcttgagaccaccttaatgaggaacacatggtctacttcctatctcctgggacacaggtcatttccagcttccagaattagtaagatttttcatataaatcctcccctacttcattgtataataaagaatttggcctttgtcttcagttcctgagaaggagactctaaatccttggaatttcccaagtaataggagtatctttgtttttcgtggcaggtccctgaaactacacctgaatttatgttgagatttgaccttaggctgcacctaattttatattgaatttgatctcagaccacacctgagtttgctgtaagatttgactgaggatggaggctgaccatgccagaatgaccaaccatatagttacagggctgggactttgagctggatgataccagcttgatccccagggaggggagaggggctagagattgagttcagccacatgccgatgattttaaccaattatatctatggtaaaactctagatataaaaacttctgacacaggttttggtcagcttcctggctggtgaacacatggatgtgctgagggatgtgcattggtatcctgtttctatgagcagagggcacacatctgtgcctgggacactcctggaccctaccatatatttgtcttcatttggctggttctgatttgtatcttttgtaatagaaccataatcataagtatagagttttcctgagttccgtgagtcattctaggaaattctccaacctcagggtgggtggcggggggttgtggagactcctgaatttatagccagttggtcagaagtgcaggtggtctggggatcctcaagctcgcaactgacatctgaagtgagagcagtcttggtggggagtatgcccttaaaccccgagggtatgcactaactccctgtagttagcatcagaattgcattacagtattgaacttccaca

SEQ ID NO: 379125 - DNA, 1835 bp, Homo sapiens
  misc_feature (1634)..(1634): n is a, c, g, or t
  misc_feature (1645)..(1645): n is a, c, g, or t
  misc_feature (1647)..(1647): n is a, c, g, or t
  misc_feature (1794)..(1794): n is a, c, g, or t
gttagtataagtaacatgaaaacattctcctccgcataagcctgcgtcagttcagtgttttaatagctggacccagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaangaaaagaaaancngaataaacaggaacagaaggccctctctgacaaaaaacccgaaatacgtacccaccctgtttgtctttcgcgtgggaaaaagaaataaatatggttatttgttttcctgtcggcccgcttgggcccagtgatttttagattgggaanggtataaaattaagggccggggtttacaacggggggatggg

SEQ ID NO: 379126 - DNA, 2909 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaatgtaaaacagggatgcctaccttatggggttggtgtgaggattaactgagatcacacttgaaagtgccttgcatgggcttggcatgtgggtgctcattacatagtcttcttgttttcttgcctctgggttgaggattcacagcactgcactacaagggtagcccctctccattctggataccttgctaggagagagtctgggcttccacctgcggccagggtgaagggaaaattcttgccatgtcagagatggatcaatgactatgaaaaaactagcctgtgattttttttcactctaagcattaagagctcctaaagccttttgtcttgttacttttttccccctcttgcatgctagaggtggaaggtagtcatttagatttcccccctcttccctcttcattgttggccaggggttctcttgggcagctgggggaaggatgtagtagatctctcttttttttttttttttgagatggagtctcatgctgttgcccaggctggagtgcagtggcatggtctcagttcactgcaacatctgctttcccggttcaagtgattctcctgcctcagcctcctgtatagctggaattacaggcatgtgccaccacgcctggctaatttttgtatttttattaaagacagtgtttcaccatgttggccaggctggtctcaaactcctgacttcaagtaatccacctgtcttggcctcccaaagtgctgctgcctggctggatgtagcagatctccaattgccttaccaaacctgcagggtctctgttaagtgtctgttaggggtcttatatgatactctggacaccgtgagaaacaggtgatggggcagatgggaacctggtatccaactcattttttatgtctgctgaatggttgactgggtgcccctttggtaagggctgggaaagtgaaccaagttgggagcagagcaggtcttgagaccaccttaatgaggaacacatggtctacttcctatctcctgggacacaggtcatttccagcttccagaattagtaagatttttcatataaatcctcccctacttcattgtataataaagaatttggcctttgtcttcagttcctgagaaggagactctaaatccttggaatttcccaagtaataggagtatctttgtttttcgtggcaggtccctgaaactacacctgaatttatgttgagatttgaccttaggctgcacctaattttatattgaatttgatctcagaccacacctgagtttgctgtaagatttgactgaggatggaggctgaccatgccagaatgaccaaccatatagttacagggctgggactttgagctggatgataccagcttgatccccagggaggggagaggggctagagattgagttcagccacatgccgatgattttaaccaattatatctatggtaaaactctagatataaaaacttctgacacaggttttggtcagcttcctggctggtgaacacatggatgtgctgagggatgtgcattggtatcctgtttctatgagcagagggcacacatctgtgcctgggacactcctggaccctaccatatatttgtcttcatttggctggttctgatttgtatcttttgtaatagaaccataatcataagtatagagttttcctgagttccgtgagtcattctaggaaattctccaacctcagggtgggtggcggggggttgtggagactcctgaatttatagccagttggtcagaagtgcaggtggtctggggatcctcaagctcgcaactgacatctgaagtgagagcagtcttggtggggagtatgcccttaaaccccgagggtatgcactaactccctgtagttagcatcagaattgcattacagtattgaacttccaca

SEQ ID NO: 379127 - DNA, 942 bp, Homo sapiens
gttagtataagtaacatgaaaacattctcctccgcataagcctgcgtcagttcagtgttttaatagctggacccagattatgagcttacagaaagcctggcctacattttactctttttggatttcttcctcatcaagagactgctgcggtgcctgtcatatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379128 - DNA, 2043 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtaaagggtttggcttccccagtgggtggagtggggggttctaggtggatgcttggctgggtgtgctgtggagaaggagcatgtgcatggctgtagacatgtgtaggtcctcccgccccattctgtctcaacacatatactggctcctgtggtccggggccctctcccagcgtctctgcccgtaattaaccaagcacattaatggtagtttcgttttccctgcgagctggccagtaattgcctctgagagcccttccttccgccagccccatccttactttactggatctcccctgtccctgaagtgtggttggggtcagaagagggactaggactgctgggtcctcagaagagactggttgacaggggtgggtatgtaagagatgcagggcgttctgggaacctgggttctgtttcctagctaaggcgaggttcaaaacagagcctggctccagtgcctgcccgcttttctttcagggctcaggatgagtgactgcccccagtgggggtgcttggcaggtgggggaggggaagaggcttcagggcagaaggctcaatcgcttttattgaccccaactgggtgatgaaaggtgatcaatgatgatcgatggaaatgacagcctgaggcttggggctgagagggcatccagacagcagtggtcagcccatccttgtgcctcctttaaccctggctgcctttctgtctcagaccatctgtctgtccccagtactaaccatcaaaccctgtgtagggctagatatctcaatgtagtccctgtacttatcccaaaggctagttgggctagagggaaacaaattcttctggaccacggttcacaatgaagaactggaaaaagacagacaggctcaaaccatagggccaagaatccttgtctcaggcctttgggtgaaggtaggggtagggggtgcaggctggatcctcatgtaaggtataaagaagtcagttggtccagagcccgggcctcaggtctccagtttgaagcctttcatgtctctctccttcctcacagtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379129 - DNA, 1633 bp, Homo sapiens
gttagtataagtaacatgaaaacattctcctccgcataagcctgcgtcagttcagtgttttaatagctggacccagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379130 - DNA, 750 bp, Homo sapiens
tggggtgggggaaaggaaccggaaacgggatggggagctggaccagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379131 - DNA, 1869 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379132 - DNA, 1769 bp, Homo sapiens
gaggaagtagggggctgggaatccgggactgtgggggcaagttgacggctcccagggtcgtcggggctgagccgagagggtggttagaatttctatattttggggtccctccctccgtatggggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379133 - DNA, 1582 bp, Homo sapiens
agacggatggggtgctggaccaggctggagtgcaatggcgcgatctcagctcactgcagcctccgcctcccgggttcaagcgattcttctgcctcagcctcccgagtaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379134 - DNA, 1725 bp, Homo sapiens
tggggtgggggaaaggaaccggaaacgggatggggagctggaccagcagattatgagcttacagaaagcctggcctacattttactctttttggatttcttcctcatcaagagactgctgcggtgcctgtcatatggggtctcattatgtcagccaggctggtcttgaactcctggcctcaagcaattcttctgccttggcctctcaaagtgctgggattacaggcatgagccactgtgcccagcacagaaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379135 - DNA, 1760 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttgcctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379136 - DNA, 954 bp, Homo sapiens
gttagtataagtaacatgaaaacattctcctccgcataagcctgcgtcagttcagtgttttaatagctggacccagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagtttcacggctgatacagcgacgaactactaatggctgtttttgaatggatgctatatgttctggacaatttgatatttaataagagtggactttgcctctcactatgtacggtgttatacgaccttttgatatatgat

SEQ ID NO: 379137 - DNA, 874 bp, Homo sapiens
gaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggagcagattatgagcttacagaaagcctggcctacattttactctttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaa

SEQ ID NO: 379138 - DNA, 3792 bp, Homo sapiens
gcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgaaaaaaaaaaaaaaaaaaaaaacaaaacaacaaaaaaaaaacaaaaaaaacaaaaaagaaagggggcgggcgcgcgcgagcacaagaagagatgtccccccccaggggggcggccaagaatgtatagcagagcgttagccccgagttgttgtggtggacaacagaggggggcgcccacaataaaaaggagagaggcagatattaatacgaggcagcgaggacagcggggcgccgcggagtcttaaaacaacacgcgtggcgtgagagagggggggaacacacaggcggcgccagcggggagaaacacccggtgggagaagaagacccctctaacgatgcggggggggggggacacacatatggggggacaaacaaaaaccaccgacaagagaatattacaaaggctccccaaggggaacaaatacaa

SEQ ID NO: 379139 - DNA, 3224 bp, Homo sapiens
attgcagatccgctatccgtcgacggatagcggatctgctccttcacctctgcaggcagaaaggtcaggtagtccagcacaggctccacctggatgtacattttcaccctggccctgaagcacgaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcattttattgattcttatgtcgacgcggccgcgaatttagtagtagta

SEQ ID NO: 379140 - DNA, 666 bp, Homo sapiens
attgcagatccgctatccgtcgacggatagcggatctgctccttcacctctgcaggcagaaaggtcaggtagtccagcacaggctccacctggatgtacattttcaccctggccctgaagcacgaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcaggtatttgtaattttactgaggaagattcttcaaattctgcc

SEQ ID NO: 379141 - DNA, 3627 bp, Homo sapiens
attgcagatccgctatccgtcgacggatagcggatctgctccttcacctctgcaggcagaaaggtcaggtagtccagcacaggctccacctggatgtacattttcaccctggccctgaagcacgaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgaaaaaaaaaaaaaaaaaaaaaacaaaacaacaaaaaaaaaacaaaaaaaacaaaaaagaaagggggcgggcgcgcgcgagcacaagaagagatgtccccccccaggggggcggccaagaatgtatagcagagcgttagccccgagttgttgtggtggacaacagaggggggcgcccacaataaaaaggagagaggcagatattaatacgaggcagcgaggacagcggggcgccgcggagtcttaaaacaacacgcgtggcgtgagagagggggggaacacacaggcggcgccagcggggagaaacacccggtgggagaagaagacccctctaacgatgcggggggggggggacacacatatggggggacaaacaaaaaccaccgacaagagaatattacaaaggctccccaaggggaacaaatacaa

SEQ ID NO: 379142 - DNA, 473 bp, Homo sapiens
attctcctgtcttagcctcccaaagggctgcgattacaggtgtgagccactgcgcccagccataattcagtacttaattcacagagtttcttctcctctctggtaacaattaggtcccctcctctcaagaacattgcatctgatcaaactgagagccagcatgaacatggaccccaaaccagagctttcagaataacaatgaacagcaaaaaccagcctttccctacacttaggaagggactgtgaatggcagggtccaaattttcaccatccaaatagaaaacccggagctgaatgccaacatggaaaccaaaatatgtcaggaatgaagtatagtacccctttacatactcaaggtcaggataggtttggagaaatttgcatctgactatttggcctcttctagtagagaagagtttttgagacagggtcttgctttgttgcccaggctggagtgccatggcatagtcagc

SEQ ID NO: 379143 - DNA, 443 bp, Homo sapiens
ctgaggttttattactaaccataatagagcaataacaactgtttactgagtgcttcctataaaactgggtagtttagtaggtgatttacatattctcccaattatttatcatacctatctattcttggaacatgaaattagttgttgatattgatattaaacagctagcaccagaccacatgcgacaaacagccaaggtaggattcagatacatctcaggggaagctgagctgccttttgccaggggtaaggcactgtgctgtttgttaggctcttgctctttcctagggaagagtcggccctggcatgtttttgaagtgggagacacgatccgactcctcttcctggttgcttcccccaacttgtagttccactgtctctctagatctgtctaccctaatgctccaagagaccccactgcggcatcacctgtagctcttgga

SEQ ID NO: 379144 - DNA, 1008 bp, Homo sapiens
  misc_feature (4)..(4): n is a, c, g, or t
  misc_feature (6)..(6): n is a, c, g, or t
  misc_feature (13)..(13): n is a, c, g, or t
  misc_feature (730)..(730): n is a, c, g, or t
agcngnggagtcnagcggcgcccgggccagcagcgatggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatnggaagtggatgaagtgctgaactggacaaatacactgaactttgatgaagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaa

SEQ ID NO: 379145 - DNA, 897 bp, Homo sapiens
  misc_feature (4)..(4): n is a, c, g, or t
  misc_feature (6)..(6): n is a, c, g, or t
  misc_feature (13)..(13): n is a, c, g, or t
agcngnggagtcnagcggcgcccgggccagcagcgatggtctaattttaggttagggacctgcgcaattttgtggatgcaactctgtctctatgcacgttaagaaaggtttatttgaagtcatacaacagggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacataatggctatctactgatggtatggatggtggacagacaaagaaggcaacaggagatccaatagcatcataaacagacacgagaaggcaagacttaggcaaacagaacacggacaaaccttacgaaaaaaaaatagaagtcgactgaaggcacaccggtaacgacaggtcaaggaaagaccggacaggcctacaggacaacaaccaaactcagtgaaaaagccgtagggaactcagatccacgcacgggcaaaccacacgagggggatgcagacaccagccgaacaacgactgccgcgggactgaaccgcgaagacggaacgaggcgg

SEQ ID NO: 379146 - DNA, 944 bp, Homo sapiens
  misc_feature (666)..(666): n is a, c, g, or t
ttcggcacaggcgggccagcagcgattggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatnggaagtggatgaagtgctgaactggacaaatacactgaactttgatgaagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaa

SEQ ID NO: 379147 - DNA, 533 bp, Homo sapiens
aggtccccaaggttgctgccgttcttagcctagatttaaaaacctttaatttttcactattttatgtagttccatatgcatatggagatttcatgatcattaggtgaaaattactctttaaattaattattcatagtaaagggaaagggtttgccttttgaaaaaagtatatcttttccatttttctaagtcttctacagtttaggccataccggttttcagaaatcccttctagttaaagtctactaaacactaactaacttactctttactttctcaagcactaatggaaatactggattataaccaatctaatactctctgggcatttctactagacactttgctcagtgtgatttaaggcagtttataatcactccttgtggtcttgaggccagttttcaattcatgagactcatatatcctagctagttttaattaattttgcaaggaagatgccaggagaagcaatattaaatgctttcttataatcaggttatttcatcttttgcgttctcgtcagccactaatct

SEQ ID NO: 379148 - DNA, 732 bp, Homo sapiens
cctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatg

SEQ ID NO: 379149 - DNA, 191 bp, Homo sapiens
cgtaatttcactggaaaggagtcatgagtcaaaactcacttggagggttactaagccagaaagcatcagagttgctgaattaagccagagccaagggacttgcctcaacatcccatcatcagtgagaagtggccatgtcaccagtataagctgtcacctcactcttgcaaccatccgctctttctgttcat

SEQ ID NO: 379150 - DNA, 496 bp, Homo sapiens
ttagacagtctaaaatctgtctagtttgcctgaagcttatgtttctccggggaaggtttccgtcactttattttcttccacttattgggccatgttttctgagtttttgttgttgttgttagaaattaggcattgtggaaaaaacaacctccttttccggtttttgcagactgactcttttccagggaggatttttgctattatcttggtattcgttctaagctttgggatcaatctgaggagaaggtttaagattttctcaggcctttttggagcatggatcttacctttgcttgtggctttttccattttctcataggcaactgcttttaaatatttatttgtcccaagagtctctcctctgggcctttgatggtctgttgtatgtctccacccataatatcttgccccaggcatctgctcttcaatctgtctgcatctttgccaagcatgatccagtgcttttcttccctaaggtgtgagatcctcaaaacag

SEQ ID NO: 379151 - DNA, 617 bp, Homo sapiens
tgccaaatactattatataatgattaattctattactaattattattcatgatccccttcctttaatttcccctgtatccctgaccatattccaggtttggtgagtataatacacacacttcccaagagctgcatgagtgggatgctttattggctactttgtctgatttagaaggatctcagaagtggtattcagtaccccagtggatgtgctgccatgtgaagcttcatcagtgttcaatgggcagggattggtttgctcgtccttgagtccttcatgtctattgttcctgcccaaattgcccatgcaaaattcagagttaggagggattgggagtggctggatgcctcccagcagattgactttgaaatttcaacaaaaattcctgtcccctcattaaaaaaaaatcttaattcctttcatgtaccattgtagattctttagattattttattcattataatcttataaagccagaatctatatggtccagtctctcagtgcagggtcaaatagacaggtcaatatccaaatgttcattaaaaataattttgtttgtcaggagatcgagaccatcctggtgaacacggtgaaacccagtctctactaaaaatac

SEQ ID NO: 379152 - DNA, 569 bp, Homo sapiens
tgacacacttagcaggcacaggcaggccggacagttgcaggcctcctctacagggtgggggagcacagcctgtgtgtactcatttccttctcttgagtaccactaatttgatagttcacgtatcctctactaagaggtagagtgagacagcttagggacatcagaagtactactttcggttcttccacatggaaacatgaggaacgaggaataagtattctttccctaacacttacagtgcacttaagacaaagttttttttttttttggactgaatatacgtcgatggacacaggcccagatatggagaaagggcaggtttcctctaggcaagatttgcacggggaacctgaagctcacatagcttcagccctgcgccacagcttagccttagtcacataggtttccctaggtcatagcccagtctcaggctgcccactttatttgaaggcaagggaaaaacaacagtccaaataagataatttgaaacaagcatcttttcatttagttttctgctacaaagttgtctttaatttcttctcctgtatcatttgccatgggtgggaggg

SEQ ID NO: 379153 - DNA, 966 bp, Homo sapiens
aaccaaagccatttcatttggctggggggttggggagtggggaggaaaacaatctttattttaccccatctattgaagagtattattacatttgaaataaaacttccatcagtacagataaccacatgtgcaatgttgggatgttattttgggcttggcttatcgagtagtcaatggaaggattcccgtcccctctctcggcagcttagtaactgctgtagccagctcggctcccttccctgtgtatctgtgtcctgctaacagccaagagatgttgcaagggaggaaatgtgagagaccttgaacctgtcaggtttatttgttttgtttttaaaggcatgttgaagtttagttctttacccttctcctaaaatctttttttaatcagcctcaaggttaaaataaggagtgactacagtatgtaaaataaggaaaggaagcattaatggtgtgatgtgacctgcctgtttttttgtaaacaagagaataggaaatgttttcaaggtagtttcacatgtcttgcaccaagctcatgcctcttgcttttcctttttgactttatctccctcagtttttcttctgctgtggccagaaagacagtcactacagttgactattgatacaaaggtgcaacagaaatattatccctgcatttttaaatataagaagtagacattaattttaccatggtgcctccctaatgtaagtgatatttattggtggttttcaacaaaggttaactattaaagaaagaaatatttgtctttatcttccttttccccttgcctcagtcgtgttattcacccctattcttgatatttcaaaggaggagattcagtagcattttcctttatattatacacatgtgtctatcccatttcaaggctcaagtcttacccccaactcatcggctcccaataggaaataaagaccatttctgcccttagttgttttacatgcaagata

SEQ ID NO: 379154 - DNA, 3745 bp, Homo sapiens
gagatcaccccagagagcattctgtctgcacttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccgagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaaaaaaaagagttaaacaaaacaaaaccaagggccctttctttggggggggggggtttgggggggtggggggggacaaaacactttttttttgccccctattcttattggcacacagctatttttcttacctttctgtgaacgtatacgatttcttcccgtctcatgcaccgacagtggatcacccccgtgtgtgtgttcacccggtgtggggcctgtgtacatcttctgggggggccgtgcggccttttctctggcggagcatagcccacgggcggcgggatatctccggctcccgctctttgtgcctggcacgcatttagccggacaccgtgtcggtggtgactccccggcgtcggaggcaccacgcctttcccccgggaggacgactatctcaggggagccccggcgcaacaaacccacgccaagagtaaacatctgttcgcaagggggcgacgagacattggcttgacaacacacctgtttatactcgctgcttagaggtctaattgtgggctagcggctctcaaaaagggggacttggtctaacaagtttaaaagcattagtaacccccattctactgtaagaacctttttcttaacccccgcactcaagggtcaaagaacgcggggcggagcactacacgccatgttcaacag

SEQ ID NO: 379155 - DNA, 3427 bp, Homo sapiens
gagatcaccccagagagcattctgtctgcacttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccgagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaaaaaaatttttgggcgcttgggccctttgaaaaagtttttaagaaccaattgcgcgtggtggggggggggctcaaaggatagtattactgtgtaaacttgtgggtacaataaacgttggttacctaaggagaagatctgtgggtcatgcactaaggtggttgggagtttttcacaatttaaaaaaaggcgccggggggggaaaacaggaggtgggttcttagaacaaaattctaggaggggaggtctcggaggcgacataaacgggagtctttttacacagagggattgtccaaagagaagaggtcgcattattaaattaacggccccggtcgtatggga

SEQ ID NO: 379156 - DNA, 2771 bp, Homo sapiens
  misc_feature (2624)..(2626): n is a, c, g, or t
gagatcaccccagagagcattctgtctgcacttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggnnnttatttttttttgcttgattatacatttttgaaactcttttaacataaacacacttaaaactgtttcaaagcaattggtcaaattgtttttataccccagaatttctttaacttataagagcatcaagctatttttttgaaaacc

SEQ ID NO: 379157 - DNA, 3099 bp, Homo sapiens
gagatcaccccagagagcattctgtctgcacttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccgagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtcgacgcggccgcgaatttagtagtagtaggcggccgc

SEQ ID NO: 379158 - DNA, 1155 bp, Homo sapiens
gagatcaccccagagagcattctgtctgcacttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaaccattcttccctcccaggtactgatggaaaccgagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaaaaaaaagagttaaacaaaacaaaaccaagggccctttctttggggggggggggtttgggggggtggggggggacaaaacactttttttttgccccctattcttattggcacacagctatttttcttacctttctgtgaacgtatacgatttcttcccgtctcatgcaccgacagtggatcacccccgtgtgtgtgttcacccggtgtggggcctgtgtacatcttctgggggggccgtgcggccttttctctggcggagcatagcccacgggcggcgggatatctccggctcccgctctttgtgcctggcacgcatttagccggacaccgtgtcggtggtgactccccggcgtcggaggcaccacgcctttcccccgggaggacgactatctcaggggagccccggcgcaacaaacccacgccaagagtaaacatctgttcgcaagggggcgacgagacattggcttgacaacacacctgtttatactcgctgcttagaggtctaattgtgggctagcggctctcaaaaagggggacttggtctaacaagtttaaaagcattagtaacccccattctactgtaagaacctttttcttaacccccgcactcaagggtcaaagaacgcggggcggagcactacacgccatgttcaacag

SEQ ID NO: 379159 - DNA, 198 bp, Homo sapiens
gtacttcctgtgtcaacagatcaattggtagctgctaattttttcttcaagccacagatacctaaagaaagttagagacactacctggagagggcttggtagagaaacagatcttgagggcatcaaagatttttctcttgagagtcactccccacccaactttggccatggtaggagtctgtacctgcctgatgaaga

SEQ ID NO: 379160 - DNA, 254 bp, Homo sapiens
accacaaaggcagaggctggaaccacacagccacaagttgagggatgtcaacagtcaccacaagctctaagagtcaagaaacagagtttccactagagcctctgcagggagcgtggctcttccagcacctcgacttcatgataatggtttcaaatttctggcctccacaattgtgagaccatgactttcggttgttttaagccacccaatttgaggtgatttgttatggcagccttagaaaatacaagtagagg

SEQ ID NO: 379161 - DNA, 439 bp, Homo sapiens
aagggtttccaagaaagtgacatttaagcagagattcaaagaatgggcaggaaataagtagacacaatttgagggtaactgtagaatggatgatggggagaagaacattctaggcagaaggaactgcatttgtaagaccagtggtgagacagaatatgggagcatgatgagttacaagaaatgaaatatgctttgggagccaagataggaggatcatttgaggccaggagtagcagacctgactatgttccctgaacaacatagcaagacctcatctctacaaaaaaactagtcaaacgtggtattgcatgcctacagttccagacactagggcagctgaggagggaggaggcttgagcccaggagttcaaggttgaagtgagctatgatcgtgccagtgctccccagcctgggtaataaagtaagactctgtctaaaa

SEQ ID NO: 379162 - DNA, 772 bp, Homo sapiens
cttaaagttcattgttatcctgatcaccaaatccagtgacctttcacttcccttgcaactggcagtgaatcacttcttggtggatattgtctcttcttgttcatcgtggagctgaaatactctgtctttaacgtcctgattgtcttcctactgtcttctttggagtcagctttgactcctcttttccatctatccaacttacaaagtccttcagattctctttgaaaggacttagccaatcgttcttttctgttcttagtgttactctaatccaagctctgaacacctcattgatgaactactatagtggcctcctaaatcttaagcttttctgtgattgctgaagaatagattagtgaattataaattatatgctactcttcagaaatgttcagtgaaaattagtgtggcatttagagccttcatcatctagcttcagtgtaccacctagccaccactacagtccttgcattgacctactggcaccccgaataggattgcctctcttgttttgactgaccaaaaaactgcccattctttaaggtctagagatgaggtacttactaaaaaaaaaaaaaaaaaaaaaaaatcccaattcacagtaacctctttctttatttaattcttacaggggccaagtactaattatatagcacctataatggaccagacatcaagctatttgacatatatttaactttacatttagagatatgtattatttcagtttttcaactgagaaaccttgagctacagagaggctgcatgtgca

SEQ ID NO: 379163 - DNA, 969 bp, Homo sapiens
gaagaagaagaaattagtgaaaatttctaattcttaaaaatcaagtgagggccagtaggatagttgagagtaactgggagcctcagacacaagggaaatctgtgctcatccatgagttctttcccagggacctttacttagtacttatcagaaattttggggacagagaagttgaccagagaaagccccctttggttccacaggtgtgcaggtactgagaccctgcccttaggaacaggcacaaaatcccacataccaccccagatttttctctcatgtgaaaagccttacacaactaggggaagggcagaaactatagggcccacggttctgcgcttatccaaagcagaggtctgcaagccatatagagcatagtttggtgccacatgaagagggaggggcagaaaagttgtggaaaagccagcccaaggcccaggtccatggggcctaagactaaggttggactcagagaactcaaaagtttacagcagctgcgttcataattgctccaaattggaaataacccagatgtctgtcagttgaggaatggataaacaaatagtcatggattccacagaatagaattttacttggcaatagaaaggaatagagggaattttatagacctcaccactgtaccggtgatcactgaggataaccactgggacaggagccatgaaagtttcatgaaaacgttcggacaatgtaaatgtttggaagtagattaagacagttatatgccaggtgcggtggctcacgcctgtaatcccaggactttgggaggccaaagtgggtggaacacgagtcaggaatttgagaccagcctggccaagatggtgaaaccccgtgtttactaaaaatataaaaattagccgggtgcactggcgcacgcctgtagtcccagctacatgggaggctgagagaggagaatcgcttgaacttgggaggtggaggttgcagtaagcagag

SEQ ID NO: 379164 - DNA, 455 bp, Homo sapiens
tgtctttttttcccataaagtatcagatctattacttgaggtaacggacacagtataaaaaattacaaactattagtaaatttagtttccttaatattaagggcttaggatcagcgaaatgctgcataaaaattttgaaaatacaagccacaaaattgcagattttaaacaaaacttatgcttatgcagggccgggcgcggtggctcacgcttgtaatcccagcactttgggaggctgaggcgggtggatcatgaggtcaggagttcgagaccagcctggacaacatggcgaaaccccatctctgctaaaaatacaaaattagctgggcatggtggtgcgagctttgggaggccaaggcaggagaatcgcttgaaccttgggaggtggaggttgcagtgagccaagatcgctccattgcactccagcctgggcaacgagaacgaaactccatctc

SEQ ID NO: 379165 - DNA, 717 bp, Homo sapiens
aaagtttgaattacattgaacatatgtctgaaatgtaagaaggggtaagccctctttcttaccatccttcctgaccatgacccctgggagtcagatatcccaggcacagcttagctttctaaccctgctgtgttgccctccatgatctctccgaatttctctccctttcctccctttacactaaaaatgctctagttctggccttcctcatctcgttaataattaagctggctgacttaactccctgccttctggttgccctcttcaatctgtccttgtctctgtcagcagcagcatcgtcctgctcaaaaccacaaagacctcctactgtggaaagacaggtattcaggaatccacatcggcacgtctaggatcccctgtgatgtgccctgaaacaacctccactgtcttagcttttactaacatcttccataatttccaggcccagcaggcctgatcttgtgctcaacttccccaacttagtctcctccttctgtcagaaatagcctttctctatctccacctgagattaatgtatcctggagagtctatctctcttttcagtgtccatatcaagggccggctcctccagaaagcctttctataccttcaacctccaacctcatatctcatcattagaaaagatcacgttctcattagaagcccaaacctcagtatcacataatatgcccatctaacaaacctgcacatgtacac

SEQ ID NO: 379166 - DNA, 594 bp, Homo sapiens
cagagaagttaagtaagaactcagatctctctagtgtcttacatattttaactaagtctaaaatgaaaggctttgtttttagcattctaaatttctccagaagacattatctccaataataccagcctgggcggtggagcaagacctgtctcaaaacatacaataccaccaaagcctttcattttaaattctaatgtagtgtttaaagtacatttagatagcagagatattgtatgccatttgtcaattacatgaggattaaaacctcacctgagccatactgcactttctatttagaaggatgaatcatttctgggaatacagttttgtaatttacatgtggaaaatttaaaactttaaggcttcaacatgagtattttatgtacataattataggaaaccaatattctttgtagctgttgaattaagttcaaagacctttcaaagataattctaagtctttttaaaaagattatttaaagtacacagcttttcagccagtattggtgaagaaacattttgagagtatgacggaataaaacatcttcttagaaatttcagctgttttttgttgagatttgttctcttcacatg

SEQ ID NO: 379167 - DNA, 425 bp, Homo sapiens
atagacaaatacggctgggcatagtgactcactatgtaatcccagcagttttggaggctgagtcaggagcatcatttcagctcaggagtttgagaccagcctaccagcctaggcaacatggtaagacacccatctcttaaaaaaaaaattacatcaacttaaaaacttctgtgttcaaagggaataatcaataaaatgggcaacttatgggatgggagaaaataattacaaatcatatatctgataaggggttaatatacataatatataaggaacttctataactcaacaacattatgacaaataaccaattaggccaggcgcagtgcctcacacctgtaatcccagcactttgtgaggccaaggcaggaagattgctgaagaccagcctgggcaacatagaaagaccccgtctctacaaaaaa

SEQ ID NO: 379168 - DNA, 708 bp, Homo sapiens
atttcctgagcacctttcatccaggcatgatgccaggtgcaccaacttacttaatcctcatagccaccacctgagcaagctcctgttttataaatggaccagttcttgttgctattgtacaagttattttctttctataacgtcctccttgtcctccttccacattcttaaagaaacttgcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctctcattatgggaaggatacatgctcctactagtaaatttagtaggtagaaaaaaattatcactatctagactgctttccatttagtctttatgcatagctttctgtctgcctatttttaccttgtgtttgtaacttactattataaaatatgcgtctctatgtgcattgtcaacattatttacaataacatggagtggattgacacgtattctctatatttggattaaaggagatagagtatgtgaaattaaatgggagaagtatctgatacataacaggcaatacaaatattatcacatagcgtcaacttatttgtgaatattgaaagctccaaaaaaaaa

SEQ ID NO: 379169 - DNA, 701 bp, Homo sapiens
agaacagagagagtttccatatatctgacacccagtttccctaatgttagcatcttgtattagtatagcacactgtgacaattattaggttggtgcaaaagtaattgcggtttttgccattgaataatgataaaccaatattggtacgttattattaactaaaatgcatacactattcagattttctgatttctttctttaacataacatcctttttctgttctaagatcccatccttgatacattacatttaggctttttgtctccttaggctccttttggctgtgacagtttctaagagttaacttgtttttgattatcttgacagttttgaggaatactggtcaggtatcttatagaccactcttcaacttggatgtttatcttatggttagactggagttatggcttttgggaagaagaccgtggagatataatgccattctcatcacatcagatcaagagtacatattgttggctggtgtggtggctcacgcctataatcccagcactttgggaggtcaaggcaggtggatcattcgaggccaggctggtctcaaacttctgagctcaagtgatccgcttgcctcggccccccaaaatgctgggattacaagcattagccaccatgcccagcctggatatggaatttttaaaaataatatattagtagtgggggcagggaggagaaaaaaagaaaa

SEQ ID NO: 379170 - DNA, 361 bp, Homo sapiens
cctgctttaggaggggtatagcaagttagttaatttctgtcgtctttctaattgcatcacatttaaggcatgttgccttaaagtcttgctgtatcttttttcttcttttgtttgtattttccctcacttcctgctcctgtggtaatcatccattttatttggtttgggtcttataggtcttgatttatgcactttccaggttgagagctcaccttttccatttggtaagaaactgagcaatggatgacggctgactagaagtagtcttctttttttatagtgatttcagctgaaacaacctgtaggtgcatgctgtttatcagtagtgctaatttgtcactaatccatactttgcttttcc

SEQ ID NO: 379171 - DNA, 1035 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttaggcagacaatgtcttcaaagagacagcagtgctgcaaaggagcaagaaaagaaggccaaagttgacacacagagaggcaaaacagtgtaggaaaaatcaacacgttttgcaaaatcaatcattgaaaatgtgtcagcattcaggagactgtctttaatttgcaatccaagtgaaatagagtatttaaatatgagaggcagtattattgagcccagcatgcctgctaccacttgtttgactagctcagaatagaacactgagaggcaagggctcaaagttaaatgaacatttatacattttaaaatcaaatgaaagattcagagtatattcatgaattaattttttttcaaaaccctaa

SEQ ID NO: 379172 - DNA, 2440 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaagtttcagatcacctaggaaatctagaaaaggagtttaatgtttttgatcagagaatttgaaaaatagaaatacagagaatgagtttcaaaagttttagataaactgatatactatatagatctatcttctagaacatattactga

SEQ ID NO: 379173 - DNA, 2594 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379174 - DNA, 2731 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagagacactggccatttttctctctccaatgcttagtgtggagtaaaggcagcttcccgcaaatttatttcaagcaagagcaatcggaagcttcgacatgtgtgaaagaggcgcatagagaacatagcttccatttcagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379175 - DNA, 2497 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccggtcagtctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaaaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379176 - DNA, 2638 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggtagaagcttaggctattgatttgaacccactattttttctaatgaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379177 - DNA, 453 bp, Homo sapiens
aattatagtggtaacagtttgaggccattagatagagatgtttgattgaaaaaaaattatcttctaggaagatctaattacttttttggttagctaaataaatttgtctgtagaaaggtgacaagtatcttttcaaataacatgaatctttttaaaaataaatttgtctttgtagtcaaaaagtggatagaacgcaaacaacttgattatttaggaattcctctgttttatggatctggtctgactgaattcaagggaagaaggtaaaatggaattattataatcaaatatttctttataactattccttatgtggtctatgagttaactattgccatgtaacaaattaccaaaacatattggcatataaccacaaacttgtattgtcttagtttctgtgagtgaggagactgcaagtggcttatctgtatgattctagatcaggatctctaa

SEQ ID NO: 379178 - DNA, 1073 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccggtcagtctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaagtgggtggagtttctctttttgccggtgcagagagaacttgtggcgggaagttggggcgcggggttggccgtaggtccccggcgtgctaagggcggacggaccaggcggctgggccgcgctgcttctcgttaccttccgcagggtcaggggccgcggcggggttggaggtcagcccaggcacatgttaacccctgggtaccagtttgctcggaaactcgtgttgaggac

SEQ ID NO: 379179 - DNA, 2547 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379180 - DNA, 2854 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccggtcagtctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaaaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379181 - DNA, 2903 bp, Homo sapiens
ggtgttaaattatcctacgattaatggcagaaataggtcctgaaccaatatgcctttgagaacttaaacgcggtgagttacatacaggccctcctaactggagtcttcgctagtaccaatagttagttgctcggcgagagctcggtaaggactagccatttggaagctcgtagtactcaggttgtggtacaggagatctaacactcctacacaaatgcatgtcgtgcttatttcgtaccaaactggtctggcggcggttcttcgtccagacgctggcgggccagggtggaggtagtaacacagctcccattccccatgtagccgcgccctctccttcccctgggcgtctccggggcgtggacaggccgctgaaaggaaccggtctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccggtcagtctcttgctctggggtcttgggtggcgggcggcacctccgcttgcagtgccggagccgcggccccgctcggaaaagggctgccgtcggagttagatgccggggactccgggccgtcccagcccccgggcctcagctccggcccgggcagagtcgctgcttccgcgtttggttcttttttccccgctgggagtgagaacaaggcgtccccttctactcacgtttgccaaaagcgggtccgacgtgttagcggaaaaaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtagtaagtaaaattagcaaagcaagctacttccatatatgtgcttgctaaatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379182 - DNA, 1499 bp, Homo sapiens
cagaggctgaggaagaattgggacctagcttggcctggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaacatacacttaaagatgcgccaagcaaccgcaaacccggcagcaaatcgcgcgcggtcgcatccactgtcgccccgagccgccctgcctcgcgggagcgtggtcccgggcgcggcccggcgagccgcacgcgctcgtctcgcgctcgcccgcctctccgtatcaggcggcgcaggcgcgagacgagaaagagcgcggggtcttagaggcgcaggccaggacaaacgcatctctgggctcattcgagatgtcggttactggaggccggggggaagcgagtgttgggtgcggtggggg

SEQ ID NO: 379183 - DNA, 331 bp, Homo sapiens
gccgcatactgggcagaacgctggggccaaaaatccacaggtttctctctccatccctgctggtttctagtcccccctccccctcttccctcccaggcttaatcatattttggaacgggtgaggtcttttgttgggtgggcaccccctgattgcttgtctgtttattttttaatgtgcaactaatttgatttgaatttccttcagtttccaggccttcctagggaaagctaagggagagggaatatgctttttaaaaatcgttttctttctttctttctttctttctttctttttctttctttctttctccttctctctccttccttcctt

SEQ ID NO: 379184 - DNA, 558 bp, Homo sapiens
cgatggaaaagtctggtttgattgttaaagtaaaatatttggcctttcagagtgtgaaaacaccattgcttcattgcaaggtttaatataaacccatttttcttgcattttcttttctttcttttgtagtaaaatgtgcttgaataatattaactattctgaccattatgtgaactaaatatatatatatataaaatgatgataccttccgctcatttgcaatgtgcttttgaatacattatataatttaatccttaaaacagccctataaatctgttttttttttttttaaacaaaaaattctgctttacaaaggaagaagttgagactcagtaaaattaagtgaccatcccagagtctcagccacttaagagtagggtgaatcttggataattctggtagcaaatttatttattggtagaaaataaatgcaaactactactgcttaagatcctctaaagtttttctcttggaaaaagaatgtattagaattgtggactttctcagtgcaaggatttatttatccttggaattaggcagaataaacaattgaatgcc

SEQ ID NO: 379185 - DNA, 413 bp, Homo sapiens
attcccgctgtgccctacattgacactatcaggccagggaaactgaacccccaaaccttcattaagcagtaaccttctggagaagaaaccttttgatggctgatctggaagaaccttgagagttcagtgtatgtggactttaaagaatgtttgggccgggcatggtggctgacacctggaataccagcacttggggaggccgaggtgggtggatcacctgagctcaggagtttgaaaccagcctgagttacatggcgaaaccctgtctctacaaaaaatacaaaaattggctggatgtggtggcacacgcctgtaatcctaactactcgggaggctgaggtgggaggaccgcttaagcctgggaggtggaggtagcaggatcatgccattgcactccagcctgggtgacagag

SEQ ID NO: 379186 - DNA, 288 bp, Homo sapiens
gtgcataatgtataaaagtaaaacaataaactcagccctatgtctcagtcagggctgcagcttcataaataaagggtgagaggaaataaattaaggaaggagtagggctcagcgcataaataaggtgtggggtgtcaggtggactcagggtgggttgacgttctcagacacaggttcccatcggccacatatttgaggtctcgcgtgaggaggcggaagaggttgaaggtgacagatgcctccaggcagccagcggactcctgtaggggaggaggggatgggtcaggg

SEQ ID NO: 379187 - DNA, 633 bp, Homo sapiens
ccctaggccactttttctaacagaggaaacaaatggtccagcagtcgttcccagcagaacagcggacctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggc

SEQ ID NO: 379188 - DNA, 614 bp, Homo sapiens
tgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacagattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatgcaaggagaaacttcggagaagactccaacacagcctggatctgggagatgagactcaggtaacaaaaagtttgaataacatggttaataagattgtggtaacagataggactgaactttgcactctgcaaacaatatacattttaaagtg

SEQ ID NO: 379189 - DNA, 103 bp, Homo sapiens
tgtagtccaggactagtttagaaatcagatatttctaaattacctgatttagattatctgatttaaattatctgattatcattaaaaacaaatgatatttgtt

SEQ ID NO: 379190 - DNA, 396 bp, Homo sapiens
gggactagattatcgagttaaatttctcatgaatagtttagtaccatccccttggtactgttctcacaatagcgagtgagtgctctcaagatctggtcatttaaaagtgtggcatctcacatgtacacacaaacatataccatatatagcaacatttgcagtccaaaagaaatataaagaacagtagagatgcaatgttaaatcataactgcataaaattaactgtagtatatactgtactactgtaacaattttgtagccacctcctgttgctattgttgtgagcccaggtgttgtgggcatctgcttagaactgcatgggacactaatcatctctgcatgagtagtttgtctctccagtaaattgcatatcacaataaaaagtgatctcttgca

SEQ ID NO: 379191 - DNA, 274 bp, Homo sapiens
tctgatatcgtcctattttcttggtttctgatttgttttctttctttctcccttgactataatctccatgaaaacaaaacaaaactaaaaacaaagctgtatttatcatgttcactggggcatcccccaaatctaagataagtggtactcaaatatcttcatataaatacatcattaagtgttgcactacatgtgtatgttgccttcttccggcactggaaaatgttcatacccttccaacggataagtaatcacacttatgatttccaaaaat

SEQ ID NO: 379192 - DNA, 366 bp, Homo sapiens
ttagtagcccaaagaactcccctagagaggaagaaatggaagaaatggcaaaacaaaaaaaggcaactgcatgagcaaagcaagagggaacgttagcttcctccaagtttagaccagaagcagaaatgaaaattgagttactgaactcaattcatgtcttaaaagttagagccacagacacaatcagagttctccttgtggaagaaaggaaaggaaacctgttttcccagcctcatctattgacccttcattcattctggagccaggttggaatcaatagtgtcttgtttggtttgaaatccttagaaaagggaatccaactcccaactgtagctacagagcttatttcagaagagcattagcatg

SEQ ID NO: 379193 - DNA, 775 bp, Homo sapiens
caatgcaatagaaaagtgagccatgttaaacaggcaaaattcattttaataatatattttatttaaccccattgtatctaaaatattgtatcagtgtgtaatcagtattttaaaattgtgggttttcacattctttttgtactacatttccaaaatcctgtgtactttacatttaacagcatatctcagttcatacgttttcatcagaaatacttgatctgtatttagatttcataaatttacagttgacaaagtagattcctgtaatacccagattgtttcaaacacacctagggactttccagtaactgcattgagtatctgggctttgcaattaacttttaaattttatttaattttaattaatttaaaacaaggcattttaatttaaaattaagatgcagttggggagctgaatgttaaattgtatttaatttggattcatgttctcagtcacactggccataattcaggggcacggtagccatatgtggttagcagccgccctattggacagcatagcactgcaccacctggtcttgctgcattaagaaatgagatggcttcattggcttactgccctcacgtgtgagggcaacttcctacttctgtcagtgagatttcttttgtgctgccatgagcccaaggtagccctcagggccccagatttgaccagatctctaagccaacttttctcttagagtcttaagactgaaattaactgatctttgaaacagaacccatcaattcatacattctacttcccatgctttaa

SEQ ID NO: 379194 - DNA, 465 bp, Homo sapiens
gaactacctgttgatttgctcctcaggactcctaaaatacatcatttagtctcaaatgtgtgttgtgtgtgtgtgtgtgtgtgtgtgtgtgtgtgtgtgtgtctactatctatacagataaatattttagagacaaggtctcactctgtctcagggtcaccaagactagaatggagaggcatgatcatagctcactgcagccttgaagtcctgggctcatgtcatcctcccacctgagccgcctgagtagctgggactacaggcgcatgccattgtgtctggctaatttttgttattttttttgtagagacaagtacttgttttgttgcccaggctggtctcaaactgctgacttcaagcaaccctcctaccctgacttcccaaactttgtttatatttttgatagaaaaaatagtatgtgtatttttgattaataaaaaatgaaaataagcccaaaaccagtaa

SEQ ID NO: 379195 - DNA, 741 bp, Homo sapiens
taggtaaattttgacatatttaggttctcaataggggctatacttaattaatacctctggaaggaaggagggaggaaggtgcaggctcagtattttgatcctttaaaatataaacatacaattttgataagtctatttaaattcgggaatatcagtttgcaaatagtgtttaacctgaattttctttatgaaattaattcactccattctttttgtttttttttggagacagagtcttgctctgttgcccaggctggagtgcagtagcgtgatctcagcttactgcaacctccacctcccgggttcaagcgattgtcctgcctcagcctaccaagtagctgggactacaggcatgcaacaccatgcccggctaattttttttttttttttttttttagtagagacggggtttcaccatgttggccaggctggtctcaagctcctgacctcacgtgatccgcccacctcagcctcccaaagtgctgggattacaggcctgagccaccatgccctaattcactccattctggaatgccagttccatggaataaacgtatgctgtagaatgaaattcatctgaatagtttacaattgatcttttctattgcaatagaagagaatataaaagaacggttaaatgcaaaatgagtaagaaacctaaaactcaggtttgagcttcttacctaaactatgtgaccttgaacaaataaatcatttaacccaactgaatttactcacctg

SEQ ID NO: 379196 - DNA, 397 bp, Homo sapiens
agaaactgagcagggaactgctttcaataacatcataaaagatagtgttttcctttatggagcagcaggagccgtggtgggatgatttagaaggtctttcatggaaataccagagagttagcagcgagctatgggaagacatagtcagaggccgtgaaacctggacccggtgtcacactgtagtcattagaagaggagtaaagtggaggacaataatggaacaggcagagctggggcaatttcagtggtgagggtcggtgtttgatttggaagtggagtctcatctgggatccaccactccctttatttgctaagagactttaagaaattaacagcctctctgagccttagtttcttcatatctaaaatgaaagtaatgatattcacctgacagcat

SEQ ID NO: 379197 - DNA, 248 bp, Homo sapiens
gttctcatgatagtgagtttcatgagctctgatggttttataagtgtttgacagtttctccttcacacactctcctgctgccttgtgaagaggctgtctacttccccttcagccatgattgtaagtttcctgaggcctccctagccatgtggaactgagagtcagttaaacttcctttgtttataaattatccaatcttgggtagtatctttatagcaatgtgagaatgggctaacacaccctctatc

SEQ ID NO: 379198 - DNA, 1209 bp, Homo sapiens
tgagccgagatcacatcactgcactccagcctggcaactgagaaagactctgtctcaaaaggaaaaaaaaaaaaaaaaaaaaaaaagaaaatgataagtctttattatgggacattaagaaaaacctaaatatcatgttcaaagtgattttggggaaacttgataaactaatgctaaaataaaggaacagtggtctcagaagacccaagacatccctggaaaagaacttttcctctagatatggaaacttgtaaagccatcttaattcctataggtttattttgtcaatgcagaatacaaaagttgaacagaacagagagcccagaaacagaccccacatgtgtatgaaaacatgtatatggaagatgacagatagcattactgatttatgccccatgcaaatctatttcagattgattaaagacttagggaaaccctatggtagaagaaatataggcagataactttatgactgcagggagggaactatttctaaaatcaagaatttctatttattaaaagttagtgaaagaataatccccaacttggaaaagacttttaccatgtatataactgacaaaggattagcatgagatatataaagaattaatatgaatcaataagagaatgatcccaccctgtccttggggcccgtggaacactgtgctagcaggctgaacaattttgcgggaatatgggaatttttctttggacgcagtcatctcattcctatgaatgtatccaaatggagcctccccctagaaagagagggggtatttgattaaagatgcatattgcagcagtgcagcaaaagtactgaagctttcatagtgtccactagtagcaggtaacaagtcctgcttggatactactctaagtacaggacacccactcaatggaataatatggagtcatcttataattatgaagacttgtcatgacatggcatcatattaagcagagcacaactcaaaattgtatcagtgttgtataaaaattatgaatcggcagaaatgtggaaaaaggaaaacttgtaatttgttcaaagagagtcttgttttttgtttttttttttggactgtcttggtacagttatgatttgtgaagtaaataagaaatacaactcagttgaaaaatggcagaagtcagataattcaaaagtaatattaataaaaatttctcagaagggaaaacactgtggctaaaagt

SEQ ID NO: 379199 - DNA, 415 bp, Homo sapiens
tgacacatattttcataagtcactggcagctataattccactgtaattgtttggctgtaattcttctacagctggaaaagaagtgcctgctctcaactcaagaaccaatggcatcatcagtggaattcaaaggaagtcccatgattctaaatgattctcatcttggtatttaaagaaacagcctgcaatctctgacacaacaggaacgggcatgacacaaacagacagaaagaaggaaatttacagctgcgttagataccaagtgtgaggcaacaggcgaactctgtatagctaatttacttgtagtttatgaagtcaaaatgcattcaggatttgtgtgctgaagacaattagacgagtgattgtgtcttccttctgtacccagcaaggatttataaaatcaacagtcacagtt

SEQ ID NO: 379200 - DNA, 2605 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttc

SEQ ID NO: 379201 - DNA, 3423 bp, Homo sapiens
ggagagttggaacattgacttgatgctgaagaagcctttcttcaaagacagctgagggtcacctgcatcagaacccttggaaatacttgtaaaacaagtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtagtcccagagctttgggaggctgaggtgggtggatcactgggtcaggagtttgagaccagcctggccaacatggtgaaaccccatcgctactaaaaaatacaaaaattagccgggcatggtggcgctcacctgtaatcccggctactcgggaggctgaggcaggagagaatcgcttgaaccggggaggtggaggctgcagtgagccgagatcgcaccactgcactccagcctgggtgatggagcaagactccatctcaaaaaaaaaaaagtcagtttaggctgggcgcagtggctcacacctgtagtcccagcactttaggaggctgaggggggtgatcacctgaggtcaggagtttgagaccagcctggccaacatggtgaaatcctgtctctgctaaaaatacaaaatttagctgggcatggtggcgtgcctgaaaccccagctacttgggaggctgaggcactagaatcgcttgagcctgggaggtggaggttgcagtgagtggagatcgcgccaacacattctagcctgagggacagagtgagactctatcatctcaaaaaaaaaaaaaaaaaaaaaaaagggaaggtcagtttatacccttgggcctgatttcctgactcttgctcacaagattgggactagtctcacaaaatacagagacttgtacaggttggcttgttcctgaaacaaaagcttctcatcctcccgaatgtagcagctttctaaggcaccagaaatgatcaagtctcttttctttcactgctctcagagcaaaagtaaatcccaaggaggcaagcgtgatcctacgcagggaagtgtcagtatgtgttctgaaaagatcactagtgatgacccgcgttcttaaggcagcggctcacagagctcctgtagcagactactcaggcaagcctatgtttgttcgtcactacaagagaggcgattttaaccaagctgagactccaagagccttttgtggtcctagaagattttaaggaatgtgagtaaagatgtgaattctgcacagagatttgcaataggcatgacaattcagaataaggagacagagaggaagttccctagcatccctcgctgaacatttctgccaattcaggcatgactgagatgggccatattgatagagcatcccaggagcatgcatgcctctggtccttacatggtgagatggagaagcctgcctgctactgagacagtgccttagtgggagcactgcccctcatcaccatcta

SEQ ID NO: 379202 - DNA, 3521 bp, Homo sapiens
tggttacctaatcaagcctgggcaatggcaggcgcccctcccccagcctcgctgccgccttgcagtttgatctcagactgctgtgctagcaatcagcgagactccgtgggcgtaggaccctccgagccagtgagatgaacccggtacctcagatggaaatgcagaaatcacccgtcttctgcgtcgctcaacgctgggagctgtagaccggagctgttcctattcggctatcttggctcctccccctggctgtgggtttcttatagatggcttttattacattgaggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtagtcccagagctttgggaggctgaggtgggtggatcactgggtcaggagtttgagaccagcctggccaacatggtgaaaccccatcgctactaaaaaatacaaaaattagccgggcatggtggcgctcacctgtaatcccggctactcgggaggctgaggcaggagagaatcgcttgaaccggggaggtggaggctgcagtgagccgagatcgcaccactgcactccagcctgggtgatggagcaagactccatctcaaaaaaaaaaaagtcagtttaggctgggcgcagtggctcacacctgtagtcccagcactttaggaggctgaggggggtgatcacctgaggtcaggagtttgagaccagcctggccaacatggtgaaatcctgtctctgctaaaaatacaaaatttagctgggcatggtggcgtgcctgaaaccccagctacttgggaggctgaggcactagaatcgcttgagcctgggaggtggaggttgcagtgagtggagatcgcgccaacacattctagcctgagggacagagtgagactctatcatctcaaaaaaaaaaaaaaaaaaaaaaaagggaaggtcagtttatacccttgggcctgatttcctgactcttgctcacaagattgggactagtctcacaaaatacagagacttgtacaggttggcttgttcctgaaacaaaagcttctcatcctcccgaatgtagcagctttctaaggcaccagaaatgatcaagtctcttttctttcactgctctcagagcaaaagtaaatcccaaggaggcaagcgtgatcctacgcagggaagtgtcagtatgtgttctgaaaagatcactagtgatgacccgcgttcttaaggcagcggctcacagagctcctgtagcagactactcaggcaagcctatgtttgttcgtcactacaagagaggcgattttaaccaagctgagactccaagagccttttgtggtcctagaagattttaaggaatgtgagtaaagatgtgaattctgcacagagatttgcaataggcatgacaattcagaataaggagacagagaggaagttccctagcatccctcgctgaacatttctgccaattcaggcatgactgagatgggccatattgatagagcatcccaggagcatgcatgcctctggtccttacatggtgagatggagaagcctgcctgctactgagacagtgccttagtgggagcactgcccctcatcaccatcta

SEQ ID NO: 379203 - DNA, 2424 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattagctggaaaagaagtgcctgctctcaactcaagaaccaatggcatcatcagtggaattcaaaggaagtcccatgattctaaatgattctcatcttggtatttaaagtattgcatgtcaaactttaggtaagttaacagtgatttataaaatgcagttccctctgagttgattaa

SEQ ID NO: 379204 - DNA, 2596 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattagctggaaaagaagtgcctgctctcaactcaagaaccaatggcatcatcagtggaattcaaaggaagtcccatgattctaaatgattctcatcttggtatttaaagaaacagcctgcaatctctgacacaacaggaacgggcatgacacaaacagacagaaagaaggaaatttacagctgcgttagataccaagtgtgaggcaacaggcgaactctgtatagctaatttacttgtagtttatgaagtcaaaatgcattcaggatttgtgtgctgaagacaattagacgagtgattgtgtcttccttctgtacccagcaaggatttataaaatcaacagtcacagtt

SEQ ID NO: 379205 - DNA, 1955 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctcggcctcccaatgtgctgcgattataggtgtgagccaccgcacccggctagctttgttcttttaaaatatccttttgccatagctgaaatgtgaaagcaccgaaatcaacagccaagggccatttatagaattggaatgaagagaaggcatcagaagtatttcatgcatggcagttcctgtgctggtcactttcacaaacattaccttgtttaattctcagccaaccctgggagatgggtattattcataagggaaccaaggttcaaaaagtctaggtgacttggatggcacccagatagatcttgaaattcagtgaaagccaaataa

SEQ ID NO: 379206 - DNA, 5169 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtagtcccagagctttgggaggctgaggtgggtggatcactgggtcaggagtttgagaccagcctggccaacatggtgaaaccccatcgctactaaaaaatacaaaaattagccgggcatggtggcgctcacctgtaatcccggctactcgggaggctgaggcaggagagaatcgcttgaaccggggaggtggaggctgcagtgagccgagatcgcaccactgcactccagcctgggtgatggagcaagactccatctcaaaaaaaaaaaagtcagtttaggctgggcgcagtggctcacacctgtagtcccagcactttaggaggctgaggggggtgatcacctgaggtcaggagtttgagaccagcctggccaacatggtgaaatcctgtctctgctaaaaatacaaaatttagctgggcatggtggcgtgcctgaaaccccagctacttgggaggctgaggcactagaatcgcttgagcctgggaggtggaggttgcagtgagtggagatcgcgccaacacattctagcctgagggacagagtgagactctatcatctcaaaaaaaaaaaaaaaaaaaaaaaagggaaggtcagtttatacccttgggcctgatttcctgactcttgctcacaagattgggactagtctcacaaaatacagagacttgtacaggttggcttgttcctgaaacaaaagcttctcatcctcccgaatgtagcagctttctaaggcaccagaaatgatcaagtctcttttctttcactgctctcagagcaaaagtaaatcccaaggaggcaagcgtgatcctacgcagggaagtgtcagtatgtgttctgaaaagatcactagtgatgacccgcgttcttaaggcagcggctcacagagctcctgtagcagactactcaggcaagcctatgtttgttcgtcactacaagagaggcgattttaaccaagctgagactccaagagccttttgtggtcctagaagattttaaggaatgtgagtaaagatgtgaattctgcacagagatttgcaataggcatgacaattcagaataaggagacagagaggaagttccctagcatccctcgctgaacatttctgccaattcaggcatgactgagatgggccatattgatagagcatcccaggagcatgcatgcctctggtccttacatggtgagatggagaagcctgcctgctactgagacagtgccttagtgggagcactgcccctcatcaccatcta

SEQ ID NO: 379207 - DNA, 2342 bp, Homo sapiens
taagatcggcctaacggcagccaccactagagatttttctgagagcttcctttctgctcactttcaaagcaggaagtctctggggagcaggggtggaatctgcatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttc

SEQ ID NO: 379208 - DNA, 2360 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattagatgattaccacatgctgagggcacctgacacagagcccggtgcagagcacttgcccactagaggtttgccactgagactgccagtgaagaacaaatcaatgcaagggc

SEQ ID NO: 379209 - DNA, 1964 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccgacccttaactgctttttctatagcaaagcc

SEQ ID NO: 379210 - DNA, 1634 bp, Homo sapiens
gagcgggccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaaggagattccactcctcaagggcaatggactccaagaaacttggtgttttctacagccttagcctaagtggtcaagaaagcacgtgctgcacggctgtccacttgggcagaattaaaaagggactctacctgtggctaagtgatcacagcagccccttgaatatgcaggaatcccccacccctcgctcagccacattggacgtttttagaagctcagcagggagggttgaggcagcaatgcaggagatccaggcatcctgttttcttggtaataaaacctatttaaggattgaatctcaaa

SEQ ID NO: 379211 - DNA, 205 bp, Homo sapiens
taacgtcaatgctgtcacacgcttcttatctctagggacactccaggcagtggcttgtcccaaggtgctggaacattctgaccagccagtgggattagagcctctataacctgggtgctcccgggcaggactcacttggtagtggcctcagatgacccctgctctccccccaccccccgcaaagactgtgcctccaggtcttggc

SEQ ID NO: 379212 - DNA, 505 bp, Homo sapiens
aggtcacaagaaagatccctaacagcactttggtttagtcagggctaggtgtcatcacctgtatgccctttggccaaggaaaccagaatttttcaggattttccccacctctggaaggctggaggaaggggaagacccactcagcagattcccatagtgcagggatcctcacaggcatgactttgccctttgtcatggatactgcagctcccagacagtcttctgggctttgatcagcctgcaatcatctgactagagcttgatttttggggcagggaaggtggtccttatatgagctgccacttaatgggccactggggatttttcaacatgaaaggtaccgagtctccaaatgctggttgtagggcctaaaaacagggctcaactccaggttctgccactttctagctgagtgatgagggctaacgtctggggagcaagatccctattttttcccattgtaaaattgggctaataaaagatgctacctactgactattaaata

SEQ ID NO: 379213 - DNA, 530 bp, Homo sapiens
ttaaggaattcattgggtttttcgaaatgttttcatttattttataggtataaacattaaagctgttattacatttctctttcaaatatacaggtatatataacatgtaatactaaaatttgtttaacttataaaaaaggttaaaaaccttacaataaaacaaggaaacaaaaagacataacacaagatctgtcctccacagaagaaaatgctcgcatttcctctcctttctccattaatgctgcattagtgcggtgtaggcagagacgtgcttccgccaggaaaaacctcattagtctctggaagaatcactgcccgcctgtctcattgtctccccagccattgcaagcacagtccttaaggtgttatgctccctggggaatctgaatccacttacatgctcccctgtgggctgcggcacttaacttcccttgtcctcaagtttggttaatgggctgggaagcgttgactgacactgctccaaggccagcagacatgaggcactgcaagttctgctctcaaaggggctt

SEQ ID NO: 379214 - DNA, 515 bp, Homo sapiens
tatgtgtatgcatatctaaaagcacagcacttaaccctttacattgtctatgatgcaaagacctttgttcacgtgtttgtctgctgaccctctccccacaattgtcttgtgaccctgacacatccccctcttcgaggaacacccacaggttgtgggaaaggcaacccacccctacaggcccagagcacaattttaaccaccatatcattctgcctctgggtaggtcagtcaagctctgtagctgatcagatgcctgtagagagaaggagacatcagtctccccttcttccaaacacccccaaattttacaagtgattttctcagatccctcagcatcaggaatggggatgaacagggcagcctgtccctttcccaacagcccagcagatatcccaagattatatctcattggctctgactaggacatgagcccaaactgaaccagttgctgtagccatggcatgcagcatcctctgtcctctggccaggccagagccacatcccacttctggatc

SEQ ID NO: 379215 - DNA, 230 bp, Homo sapiens
agaaccttataagtatgaaacagttcttattccagataatataagcattcactcaggtaatataatcacatctcagtggaacttcagctatagggagtagatcttcatagtaaattaacattctgaggaattaacaagtaactgcaatgccttccttcccagcctctctccatgaaaaagctgaggcaccttacaaagatcgacctaaaacaaggtgaaataagaagatg

SEQ ID NO: 379216 - DNA, 716 bp, Homo sapiens
gtagttggagatttatactttgtacacaaatatattgtggtcaaaatctttctgtaacattatttctctgtcttagcacaggctttacttaacatctctccttgattgtcatttcattcttttgcatgttatttactataggtatcgaggtagattttgagaccaaccaataaatcttcttgaaacttagcttcttagaaaggaaaatctaaataccagccttttaaaaaaagtagctgaattaaaggatgagtgaaccaaaggcaaaggtagcctttcctcagcctgtgttttagctttctaaatgttaacaatagcttcattcttgacttattggtaacattcaaaatactacttattatttcatactttagcacatgtatctattcagctttaatgctattaacgagttgttaacctaagttttcatttgttggcgggcacggtggctcacacctgtaatcctagcactttgggaggccgaggtgggcagatcacctaaggtcaggagttcgagaccagcctggtcaacatggtgaaaccctgtcttgaccaaaaatagaaaaattagctaggcatggtggcgcacacttgtaatcccagctacttggcaggctgaggcaggataatcgcttgaacccaggagacagaggttgcagtgagccgagatcacaccactccactccatcctgggcgacagagcaagactgcatctc

SEQ ID NO: 379217 - DNA, 211 bp, Homo sapiens
tacgctagggtctcgggaagccccagggcagaaagctgaaaagctaggagaagacttggtttcgaggacctcttccaaacccccttactaactggtgtagaaaagggagagtgaagccgggcctttgcttgggtgggttcgttaggggtcagaggcgtccgctcggccagtgtcgaaggaaggtggccatttgagccggtcgctccgcatc

SEQ ID NO: 379218 - DNA, 399 bp, Homo sapiens
ttattacacagggacggggctgtagcacacggctgggtctcgaatgtgaagaggagttaggtccaggcgagtggctcagaaatgagaatgtgaataggaactttgggcttaacgatgtcaccccagagcagaggggttggtgttgcaaggaacggagagacggcaaagtccgaagggaggtgacgcaggaaaacagacggtggcagtcacaggagagtgctgcacagacctccctgccagggagaagagctgggaggagtttggtaggtggaccaccttccacatccacatgcaccgcagtttcacaccaagacccggagctctcaggttgctccccactgactagtgagtgcccagaggcacagagccgggccatccccgcccagtacccacagtggc

SEQ ID NO: 379219 - DNA, 1557 bp, Homo sapiens
tctcatatgaaatatgtattttagggaagaaatacaaacaataaaaataaatgcagagaattagcaaagttgttagcaacttctactttccagtcagattgcccttgtccaattgttggctctgacacttaaaaagctgtgtgaccttgaacaagatgcttaacagatcatcagtgcaattgtttggttgttcaaatgggtataataatagtatggtaggctaaataatgtctggacatgaagagattacactggtgggtttcatgtaatcacaagggtctttacataagggagagagaataagagtagtaggagtaggagatgtaacaaaagaagcaagtgtttggagtgaaagaaaaaggagttcatgagccaaggaatgcaggcagcctttaggagctgaaataggcattatttatctcacccatgggtgtttgtcaacacctctactaacactacattaatacattttcatttcccaatgaagaatgtttaaaatgtataatgtgtaatttccatctgtatctttccattaatgtaatacccatttccactttctcttctattaactctctgaattatttgcctatgtttctatcaccttagaggttttgctggcatattacttggtaggaaaatagcaagttttaatacaagatgtgtgatatgagcccaatattgtaaataaacatttaaccctatatgtatgtgtgcataagttatacatatatatattatgtgtgaatgcacataatgtacacacacatgcatagatgtacatgtacatctgtacccatatattatctttaaatgtattccaaattgtaagtagcttgttctaggagatgagctgtgaaaagcataatcaattatgttacttcttatttcttacatttcaagtagaagacaggaagagtggtgaacataatttaacataagatacttagttgtctatgctttggagatgacatgaggctaattatattaggacaatagcataaaattatcatcccactaatgttaaaactaaaacaatataggagaagctgaaaaagattaaaccctggtaattcttcttagaaattttgttcagccaggtgcagtggctcacgcctgtaagcccagcagtttgggaggctgaggtgggtggatcacttgaggtcaggagttcaagactagcctggcccacatagtgaaaccctgtctctactaaaaatacaaaaattagcctggtgtggtggtaggcacctgtaatcccagctacttggggggctgaggcaggagaaccacttgaatccaggaggtggagattgcagtgagccgagatcgcaccattgcactccagcctgggttcatgtttgaagagagaagcatgacaaaacacatgagcagcaatatgaaagcatatatttatacttcattacttcattctaagttggaaacatgaagtaataaaagtaacctgattctttatttagagataaagtaatgacactttaaagtaacattagaccaggcacagtgtctcactcctgtaatcccagcactttgggaggc

SEQ ID NO: 379220 - DNA, 1262 bp, Homo sapiens
tctcatatgaaatatgtattttagggaagaaatacaaacaataaaaataaatgcagagaattagcaaagttgttagcaacttctactttccagtcagattgcccttgtccaattgttggctctgacacttaaaaagctgtgtgaccttgaacaagatgcttaacagatcatcagtgcaattgtttggttgttcaaatgggtataataatagtatggtaggctaaataatgtctggacatgaagagattacactggtgggtttcatgtaatcacaagggtctttacataagggagagagaataagagtagtaggagtaggagatgtaacaaaagaagcaagtgtttggagtgaaagaaaaaggagttcatgagccaaggaatgcaggcagcctttaggagctgaaataggcattatttatctcacccatgggtgtttgtcaacacctctactaacactacattaatacattttcatttcccaatgaagaatgtttaaaatgtataatgtgtaatttccatctgtatctttccattaatgtaatacccatttccactttctcttctattaactctctgaattatttgcctatgtttctatcaccttagaggttttgctggcatattacttggtaggaaaatagcaagttttaatacaagatgtgtgatatgagcccaatattgtaaataaacatttaaccctatatgtatgtgtgcataagttatacatatatatattatgtgtgaatgcacataatgtacacacacatgcatagatgtacatgtacatctgtacccatatattatctttaaatgtattccaaattgtaagtagcttgttctaggagatgagctgtgaaaagcataatcaattatgttacttcttatttcttacatttcaagtagaagacaggaagagtggtgaacataatttaacataagatacttagttgtctatgctttggagatgacatgaggctaattatattaggacaatagcataaaattatcatcccactaatgttaaaactaaaacaatataggagaagctgaaaaagattaaaccctggtaattcttcttagaaattttgttcagccaggtgcagtggctcacgcctgtaagcccagcagtttgggaggctgaggtgggtggatcacttgaggtcaggagttcaagactagcctgggcaacaaagcaagttgagaaactccgtctatactaaaaaattcaaaattcccggacgtgtggcgcatgcctgtatcca

SEQ ID NO: 379221 - DNA, 593 bp, Homo sapiens
atttattgagccagtatcttctaaacagtgtttcaggtggctggtattcattagtgagccaaataaagttctcttctcatatgaaatatgtattttagggaagaaatacaaacaataaaaataaatgcagagaattagcaaagttgttagcaacttctactttccagtcagattgcccttgtccaattgttggctctgacacttaaaaagctgtgtgaccttgaacaagatgcttaacagatcatcagtgcaattgtttggttgttcaaatgggtataataatagtatggtaggctaaataatgtctggacatgaagagattacactggtgggtttcatgtaatcacaagggtctttacataagggagagagaataagagtagtaggagtaggagatgtaacaaaagaagcaagtgtttggagtgaaagaaaaaggagttcatgagccaaggaatgcaggcagcctttaggagctgaaataggcaggaaaacagattatccactacagtctccaggaggaaacagactagacaacttttttatttatctcacccatgggtgtttgtcaacacctctactaacactacattaat

SEQ ID NO: 379222 - DNA, 701 bp, Homo sapiens
gcggccgcggagaggcacttaaaagccccgtgttaccctagaccttaaaaaaaaaaaaaaaaaaactgcgtgtttccacccccgtcggcctgcagtggaagggcccgagcagaaccaacggggcaggggacgctgagcgcgccgtgtttctcctcccgtctgcctggagtagaacggctcgggcggaaccaacgggcagccgcgggggcgttgtgggccgcggcgcgtttccccggctccgtggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcggtgggttctgcgtgcggggtgctctgctcggtgatcggtgcttggtgctgcgtgctcggtgctcggtgctgggtgctgggtgccggtactgatgctgagtgtgcgggcgtccggggtttccctgcccggattcgctcctgggggtcctttcctatggctggcgctgtgcgcggaaaacgctggt

SEQ ID NO: 379223 - DNA, 1892 bp, Homo sapiens
gcggccgcggagaggcacttaaaagccccgtgttaccctagaccttaaaaaaaaaaaaaaaaaaactgcgtgtttccacccccgtcggcctgcagtggaagggcccgagcagaaccaacggggcaggggacgctgagcgcgccgtgtttctcctcccgtctgcctggagtagaacggctcgggcggaaccaacgggcagccgcgggggcgttgtgggccgcggcgcgtttccccggctccgtggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggtcccgcaggccctgcaccgagtcgccttgtccatggcgctgccctgccccatgcttcctgcgtcctgagtaggaggtatctccgagacaggaaaagtggccgctctctctcactttttctggaactcatggtggtctcctgggcttggtcactgtctctcaccagcatgtttctttgtgcggtcaggaattatttccaaatgctcctgaagcctagtgttttagtgaacattagtgattgttagcagtggttcaaaaaaaaaaaactttttttttttttgagacagagtcttgctctgtgacccaggctggagtgtggtggtgccatctcagctcactgcaacctccgcctccctgctcaagtgatcctctcgcctcagcctcctgagtagctgggactacaggtgtccaccaccacgctgggctaatttttgttttttgttattttattttattttactttttttgagagatgggattttgctgtgttgtccag

SEQ ID NO: 379224 - DNA, 429 bp, Homo sapiens
gcctcccaaagtgctagggttaccgtcttgagccactgcgccgggcacaacttcttattcttaatgaggatttattctgaatccctcaaaagtgactaggttcaagtgttcagcaccatagcttgctgtgtcctgatgtaggctgaattatttttctttttgcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatattttttaagtaagtggttttcttaaaggagatttaatttctttgccctcatttttccattagaacaacgcttcttcggtgaagttcttttgtacttccaaatgtcgcaggtgagcccaaaatgtattcta

SEQ ID NO: 379225 - DNA, 593 bp, Homo sapiens
caagcgtgagccactgcacctggccaaaaattctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagct

SEQ ID NO: 379226 - DNA, 3861 bp, Homo sapiens
gagatggagtctcgctctgtcacccaggctggagtgcaatggtgagatctcggctcactgcaacctccacctcctgggttcaggcgattctcctgcctcccaatcctagtagctgggagtatcaggtgagtcgcagccccacgcacgcccggataatttttttatttttagtcgagacgggtttcaccacgttggccaggatggtctcgaactcctgacctcaggtgatccacccgcctcggcctcccaaagcactgggattacaggcgtgagccaccgcgcccggcctccatatccattcttgggaacacttgttgcttagctgaacggagcccgcatcctgctgtggcggcactcgccccggtgctggtctgagcagacgcctcctttctcttgcagaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgtaaacccgaattcgggaccatcacagtttgattagcctcagcctcaagagctggcacatgcttgtgaacttgtgctttcatattttcctaacctgtgtgctctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcaggcagcgaacattaagaattacggcagtcggccaaacgcaccctattgctggatggcatgggaaccctccttgggagccttctatgggccagccagcttcagcacttttgtaaactgcatgtactttctgagcatatttattcagttgaaaagacaccctgagcgcaaatatgagcttaaggagcccactggccagcaacagagattggcatgccaatgaaaatggcgaaataaatcatcaggaaatcatttctttgtctctgatttctacatcagccttggaaaatgagcacacttttcattctcagctcttggggccagccttactttgctcttatatgttgcactgtggatgtttggggctttggctgtttctttgtattaccctttggacttggtttttagcttcgtttttggagccacaagtttaagcttcagtgcattcttcatggtccaccattgtgttaatagggaggatcttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgattcaagcttcaaaattcctcccagggctgcaaattaacaaacttgcaggcggctgcagctcagtgccatgccaattctttacctttgaactccacccctcagcttgataatagtctgacagaacattcaatggacaatgatattaaaatgcacgctggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaagatgcgttaagggaagccagctgtggttgaacttcaaaatcagcaaaaatcttatggcctcaacttggccattcagaatggaccaattaaaagcaatgggcaggagggacccttgctcggtaccgatagcactggcaatgttaccactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtt

SEQ ID NO: 379227 - DNA, 982 bp, Homo sapiens
atacaggaagtgacgatacttttggcgcgcgcggttgctgtttcttctctggctccgggaccggccgcggccccgggctgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaaggaccgcttggagcagttagaaaggaagccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaaggggtctgtcacggttttccccttagcaccaaggcgctcccagcccgatgacgggacgatgtgtctctctatcctgtctcccggcaagaacaagagccagaaacggtccggtcccccggaaaacccaccggaagattccagatccct

SEQ ID NO: 379228 - DNA, 3785 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgga

SEQ ID NO: 379229 - DNA, 3764 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggcaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgga

SEQ ID NO: 379230 - DNA, 3035 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcgtgcgcagaagccagcacagttaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379231 - DNA, 3115 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatattttttaagtaagtggttttcttaaaggagatttaatttctttgccctcatttttccattagaacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379232 - DNA, 3083 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatattttttaagtaagtggttttcttaaaggagatttaatttctttgccctcatttttccattagaacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379233 - DNA, 2581 bp, Homo sapiens
  misc_feature (9)..(9): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagttcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgga

SEQ ID NO: 379234 - DNA, 3030 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcgtgcgcagaagccagcacagttaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379235 - DNA, 3244 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379236 - DNA, 3201 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379237 - DNA, 4357 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatggaaaacacaaaaaaaaaaaaaacaataaaaaaaaaaaaaaaaaaaaaaaaaaaatcaccaggaaaagcgactagaagatagcaaaaaaacgggtaaggatagaaatgaacataatagaatgtactctgatgataaagggagacgaggtaccggactcaaactttgcctaacccttgttgcgtgaccaattcccatggctaacagaagacgtgttaggcatttcaattgaccaactatgaaacaatcccacactagacctccgcacggggactacacagacatcgcagcgacgccggaaagcccacacacaggcgcgcatcccaacggagcgtaacagggaaggcacaacactaccctgcgcacaacaacagtaaggcccagcagagaaggaaaacgtcgacatggacaacgacacaccgggcacaaactattggccgcgacgaagaactgacgaggtcaactcacaattaacaccccaggacgaagccaaccaggcaaatgatagcagcgaaccgaagcacagaagaagcaaacgaacacagagaaccaacatagccaacacaacagaagcgac

SEQ ID NO: 379238 - DNA, 2846 bp, Homo sapiens
  misc_feature (1626)..(1626): n is a, c, g, or t
gaattccattccattccaatccattcctttcctttcgcttgcattccattctattcccttctactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggtgacccgcccnggcccacccacagccgcccatctgtcgttgcaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379239 - DNA, 3335 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379240 - DNA, 3635 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgccgtctaggagcgtaatcggtaccgagctc

SEQ ID NO: 379241 - DNA, 2943 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaagcctcccacagcttcgcgggcactggccttcctgaacacctctcctggcgtcttaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379242 - DNA, 3148 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaagcctcccacagcttcgcgggcactggccttcctgaacacctctcctggcgtcttaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379243 - DNA, 2413 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgagagactgagagagggtccacttcacagaacaggggc

SEQ ID NO: 379244 - DNA, 1605 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379245 - DNA, 2067 bp, Homo sapiens
  misc_feature (1927)..(1927): n is a, c, g, or t
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaagaatacttcanggcgtggactgttggtcacggggtgctcttcggggagtgtgatcagaagctctgttccgggagtcaattcgtccactcaccagggtcccgtctgggcctaggaaattgccggtaggagtcccgaaaaaactagagcaaat

SEQ ID NO: 379246 - DNA, 2654 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgaga

SEQ ID NO: 379247 - DNA, 2535 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcaggtcaggccctcccctcgccccgggccgctgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgctcaggcagctatcaataaggcaggatattgttgggagtgatttggaagggacaagcctgagaaggtaccagtggcctcgggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccacccagagtacgtgacatccggcctgggcaccggccccaaggtacaccgaggggtaggtgccctggcatggggcatcatgctgcgcctggcaggtagggcccgtcctcagtgtcatcctggtacaagcaggggacacatccactttgacagagagactctccggatggccttttttttggagactgggtctgtctctgtcatccaggctggagtggagtggcttaatcatagctcactggagcctccacctcccaggctcaaacaatcctcccatctcagcctcctgagtagctggaactacaggcgcaagccaccatgcctggctaatttttttattttgtagagaagagttttggccaggcacagtggctcacgcctgtaatcccagcactttgggaggccgaggcggtgggcggatcagaggtcaggagttcgagaccagcctggccaatatggtgaaatcctgtctctactaaaaatacaaa

SEQ ID NO: 379248 - DNA, 507 bp, Homo sapiens
tgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcgtgcgcagaagccagcacagtgtgagtcttttctgggggatgtttggcataagtgtgtaggattcatttaaagcccagctaagtaaccgcttcagaagaaagtgagagatgtgctggctgaagtcctctcgtgtcgtgagagggaccgtgagtgtctgtgtgcggccaggacacaggacgtgtgtttatccgctgggacattcgccactggccccgttagagaagtggcttccagcgtctgtggatgagctggtttccgaccaagcaaagttaatcgttacgtgaaaggcactagttttggggtggtggtagcttgtttgtttaaaaacatttccccaaattcacctttatggtttatctcataag

SEQ ID NO: 379249 - DNA, 320 bp, Homo sapiens
agagcacgaacgtcggaaacgacatcgagaagaacaggataaagctcgccgggaatgggaaagacagaagagaagggaaatggcaagggagcattccaggagagaaaggtgagtgggctgggtcagttgaggactttatgaaagggccgtggtagtgtgtcctgtcacagcaatgaagaagaatttggcaatagaagtcacatttgttgcagaagtggtagacatggaaacagcacagtgaacgctggacgaggctgaccaagagaactgtcctgagggagtgagttttcactgcatctggaagtaagaacgggtgtgat

SEQ ID NO: 379250 - DNA, 1404 bp, Homo sapiens
caggaggaggttcatgatccttacttactcctagcttcgtaattaggttcaacttttccagttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcaggtcaggccctcccctcgccccgggccgctgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgctcaggcagctatcaataaggcaggatattgttgggagtgatttggaagggacaagcctgagaaggtaccagtggcctcgggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccacccagagtacgtgacatccggcctgggcaccggccccaaggtacaccgaggggtaggtgccctggcatggggcatcatgctgcgcctggcaggtagggcccgtcctcagtgtcatcctggtacaagcaggggacacatccactttgacagagagactctccggatggccttttttttggagactgggtctgtctctgtcatccaggctggagtggagtggcttaatcatagctcactggagcctccacctcccaggctcaaacaatcctcccatctcagcctcctgagtagctggaactacaggcgcaagccaccatgcctggctaatttttttattttgtagagaagagttttggccaggcacagtggctcacgcctgtaatcccagcactttgggaggccgaggcggtgggcggatcagaggtcaggagttcgagaccagcctggccaatatggtgaaatcctgtctctactaaaaatacaaa

SEQ ID NO: 379251 - DNA, 2996 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379252 - DNA, 2563 bp, Homo sapiens
  misc_feature (43)..(43): n is a, c, g, or t
cggacgcgtgggtcgacggacgcgtgggtcgaccacgcgtcgngctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgga

SEQ ID NO: 379253 - DNA, 3178 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgaccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatgga

SEQ ID NO: 379254 - DNA, 3828 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatggaaaaaaaaaaccacatactcataaaataaggcgcgtttacaact

SEQ ID NO: 379255 - DNA, 2309 bp, Homo sapiens
tattgtacaattacccaccactggatttgactcagagaggacccccagagggtgtctccatcttccctatttattttcagcccttgagggcttcattgtagatcaaagccaaggcccccaggaaggtgacatactcctggaagttcacctcctggtccttgttccggtccaagtcttccatcagccttgcaatttcagcatcctgcagcttctaatgtgttagaatgtgaaatccatactcagtggtgatgacaaccctggattcttccccttccccctcccaggcaatcctctctgcaagtggctctgtgctccctcatcaccaaggacccatgtcactttggcattgcttctcctcagctacttctcagttactggtcctcatttggagagatggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379256 - DNA, 4191 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctggttatttttgtccaaacgaagcagccgtggtagtagctgtctatgattcttgctcagcaaagtaaaataaatgttaaatatggaaaaaaaaaaaaaaaaaaaaaaaaaaggggggggggttaaaaaataaccttggaggggcccaaggtttaggggtacccggtttttttgtaaaaaggggggcccaataggggagggaaaaaaagaagcagggcgcggtttacaacggtcgtgctgggaaacctggtaggtgggatctttgggagggaccctacttgtggtgggccacgtgggcacctactagaagttaaaggttaggaaaattaattagggttcgggtaacaccgattgtggtgaagttgttccggtgtttgaatagggggttatttataaaaagagggaagaagagagatatatgagaggagtgatatacctgacagatcaaaagaaacgaagaaagaatagttataaataaaaggagagtataatg

SEQ ID NO: 379257 - DNA, 3449 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379258 - DNA, 3195 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggtgggtctggccctgccgcaggtgcgctatggatttcagaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379259 - DNA, 1903 bp, Homo sapiens
ttcactagccgctctgcctgaaccaggtatgtgagcgcacacgaacactgaggtgaaccatgatagaactgagtaacattgaaaaccacctcttggtggttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379260 - DNA, 3076 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379261 - DNA, 3191 bp, Homo sapiens
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaagcctcccacagcttcgcgggcactggccttcctgaacacctctcctggcgtcttaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379262 - DNA, 3344 bp, Homo sapiens
  misc_feature (9)..(9): n is a, c, g, or t
  misc_feature (1165)..(1165): n is a, c, g, or t
ggcactcanaacttctccccacctgacccagggctgtgggcatcctcagactatcccagaggcatcgcaagccttcaagctgcagcattgcacggcactcaagggctatgaccaacggaggccgttcagtcgcttctgtttagaggaaggccccctacctcttccacaccctgccctcctatcccttccacaccctgggctgcgtgactccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaantgatctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccatcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgaggcgcctcacgaggtaaccagcaggtaaatggagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtcggcgtcgctctgctcggcgccccggcccgcgccgaagtcggaagtgcagctcacggcgcagtttcttttggagtcctggacctgagcaagcgctgttttatgcgtcatcatcccgcgcagacacaggaagtgccgcacagagcgagcccctgtcgtcttgagttctgggccagaggtcggctattatatca

SEQ ID NO: 379263 - DNA, 966 bp, Homo sapiens
  misc_feature (43)..(43): n is a, c, g, or t
cggacgcgtgggtcgacggacgcgtgggtcgaccacgcgtcgnagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaaaaaaac

SEQ ID NO: 379264 - DNA, 1626 bp, Homo sapiens
  misc_feature (1614)..(1614): n is a, c, g, or t
ggcacgaggaggaagtgacgatacttttggcgcgcgccggttgctgtttcttctctggctccgggaccggcggcggcggcggcggcacgggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactctatggaagacagaggagaagaagatgattctttggccatcaaaccaccccagcaaatgtctcggaaagaaaaagttcatcacagaaaagatgaaaagagaaaagagaaacgtaggcatcgtagccattcagcagaaggggggaagcatgctagagtgaaagaaaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcacacattatggaggcgcngtcgcctacgca

SEQ ID NO: 379265 - DNA, 500 bp, Homo sapiens
actgttgacacatgttctgatagaagtttgaacttgtaactaagtggaactaaggtaaactaaatggggcaatctgtaagtattttagtggctcttgaaggaggaccagttcgtagacatcaccctctcctgagcagttagaaagctgcttggaaagagctgtgcttctctcttggaaagaccgtgagactggggaagagcgccagccagtgaagtcaggacttctgtgttctggcgctggtttctacctctcactctagccaggtgacccgaggctggtaagtcacttcacttctctggattcctccacttgtaaaacatgagaagtgaactggatggtcctcccagcaactgcagtttcattctttatctttaaagaaatgtattttttaaaaaaaacaatgtgagaatgatgaaaagcttctcgctactcaatgtccttgccaatgatagtttgatagggaacctaaagttaatagctcccacagctctgactcttt

SEQ ID NO: 379266 - DNA, 760 bp, Homo sapiens
aaatacacacacatacatgtatacatacatagagatgtgatagccggcctcaagtttgcctcaataatcctggcctcctggtatttacacccttatgttgtcctctccccatagtcccctgcagggtcagtgagtgtgaccaattaaatagctgaagtgatggatatcacttctgagattactaagacagtgcagcttccattttggtctctctctctctctctctcatcacttactctgggggaagccagtggccatgtcatgaggaaattcaagtggactatagaaaggcccaggaggtgaggaactgagttctctggccaacagccaagaaagaactgtggcttcctgccaacagtcagagagagcgagcttggatgaaacttccctcccacaagtagagcctttagatggcccccagcccaggccaacagcttgacagcagccctgtgagaaaccttgaaccagaaccacccacctacgctactcttggattcctgactcatggaaattatgagataataaatgttttatatcataagtgtctaaggtttgaggtaatttgttacagagcaatagtgactaatacaagagttcagagggcaaaacagtcacacatacttaaaggctttaaaaagtcccagcagttttctgtctcgcctcttcttagccacccagacacattacccagaggctactgaccaagtgctaggctgccactgccagatttcctgttagaagaagaaaataaatttctagt

SEQ ID NO: 379267 - DNA, 1344 bp, Homo sapiens
tgagaaagggtcttgctctgttacccaggctggagtgcagtgatcacagctcactgtaacctcaaactcctgggctccggtgatcttcctgcctcagcctcctcagtagctggcaccaggggcacatgctgctgtgcctggctgatttttttttcttgtttttgtagagaccagttctctctaagcacaaagacttatttgtgctttcaacatcaaaacttataacaggcctgtaatcccaacactttgggaggctgaggcaggtgggtcacgtggggtcaggagttcgagatcagcctgggcaacatggtgaaacccctatctccactaaacatacaaaaattagccaggcatcatggcccgcgcctgtggtcccagctactagggaggctgaggcaggtgggtcacgtggggtcaggagttcgagatcagcctgggcaacatggcgaaacccccatctctaccaaaaatacaaaaatcagccaggcatcatggcccacgcctgtggtcccagctactagggaggctgaggtggaaggatcgcttaagtcctggggtcaaggttgcagtgagttattatcgcaccactgtactccagcctgggcaacagtgagaccctgcctcaaaaaaaaaaggaaaatgaaacaaaaacttacttgcctactcccacctaattaggtaggaacatcacctatatcccaatatttaactttgttacataatgtttgagctgaggaggaagttctgagatcataaagaacaattcctttatttttcagagaatctgtgtgcctagagaggttatatattttgttctcaccatttagcagtttgaaaaatctgtatcacttttatatcacagaacattcctcaacaatgaatcgtcatggtcccatttaaaaagccttgatgcaggcactaccatccgtgcttcatacatcccaaacctcttcacgtagatagttatcccagcctttgcctctaatgcactgatttctaattctaaatgcagagatggtgaatttgcagcaactaggcaaggagcttttggggctacctgggcctgcaattgtctaagaaataagttttaagaattcagaggctgaaaacagcaatcctacttgggatgtcgtcatgcttacttcagcctgaatcacacagaagaaagccttcaagcatggacctgaagcaatgctgtaaacacaaacatcaaaaggaagaggaggccaggtgtggtggctcacgcatgtaatcccagcactttgggaagcggaggcaggtggatcacctgaggtcaggaattcaagatcagcctggccaacatggtgaaaccctgtctctgct

SEQ ID NO: 379268 - DNA, 400 bp, Homo sapiens
atttgctattgaatcatgctggttcagttcaccatatctttcctcagtgcaggccggaactctgcataaatactatactgggatatttgtcatgtggttaatgatttgcatgcttaccctagagagggaaagatgaaagaatgcaaaggggtatactttgttaccgggtggagtagatatttttttgtgttgtatggtttaatgataagttaaccacctatcccacaaaatgtaccttcctgacattaaaagaataatgatacatggatcgttgtatagcttgtataaaatgatggcagatattttcttggtacaggttttaacaaaaagaaggaaaagaacataatcattagtgtagctgaagaacttggcaatgctgacagttttgctaagagccctt

SEQ ID NO: 379269 - DNA, 475 bp, Homo sapiens
agcattatacatagtatcccacaagtggaaacaacacaaatttccatcagttgattattggaaaaaacaaaatgtggtatatgtataaaatatatcaccctgcttttatgtttctaaataatcttttcattaaacttttttcagttaaaccctttgagtatgccatttactttttctttggacactgattgttagagtgggttaagagttttgcacaattgtctttataatttaaacaattttttttatttctggttaaatcgtatttcttatccctaaaacttatattgtatctattattgttaaatattaatatcattaataacttactcaattcctttaatatatataagcctattcagattatgtaatttttttggtgtgagacatggcagattgtgtctttcaagaactttgtccatttcatgaagattatcaactttgtgtgcatagagctgtttaagatattcctttc

SEQ ID NO: 379270 - DNA, 426 bp, Homo sapiens
tgcctgggcagagtactgtcccgtctctgagtctcagaggcctcccctgtgaaataagtatccaagcatcataatcatgacctgtttcagtccctaggagtgttatgaggatcaaatgaaattgttccatgttgtaaaaccactttacacgatcatgtcccactgcggtctcaaactcaagcaatcctcctacctcagcctcccgagtagctggggccacagtaatgcaccaccatacccagctaggttttatatatactgtcatatccttaatttcttataaattttagttaaaaaattttctaggacaggtgcagtggctcacacctgtaatcccaacactttgggaggctgaagtaggaggatcacttgaatccaggagttcaagaccaacctgggcaacatagacagaccttgtctctatta

SEQ ID NO: 379271 - DNA, 298 bp, Homo sapiens
aaaaagaataaggaccaaaacaatagcatgtgaggatttcaccttactggtgaagacacacctgtcctcagagtaggagacggcttccaggagtatcagcaaaaacaaactaaaggaaaagacagaaatatttaactacataaaaagtcaaccttatttttaattttaatttaaaaaatgtaaatgttatattaattttattgagatgggtctcgcaacgttgcccaggctggtctcgaactcctgggctcaagcaatcctcccgcctcagcctcccaaagtgctgggattacaggca

SEQ ID NO: 379272 - DNA, 466 bp, Homo sapiens
ataatggctatagaaaacaaaaattaaataattgctgggatatatttaagttttccagaataaaagaaaatgatggcttcagctgatctccccaactaccttcctgtgtttccttttcttgaccaagttcattagagaaagcccttccttaagatgttacattttctacttctaacagatcaactaaaacaatgattgtaacttttttgcttgggacttaagactgttgacctatttcttatgaaatggtgcctggtgtttttctggtatctatctttaagctgttttattgatgaaagggatacttgcattatttgatttttctaaccctttatctcaagacccaagaaattatatgacaaacttttatttttatttttgagatggagtctcactctgtcacccaggctagagtacagtggcgcaatctcagctcactgtaacctccgcctcccaggttcaagca

SEQ ID NO: 379273 - DNA, 295 bp, Homo sapiens
tagtagagatggggtttcaccgtattagccaggatggtctcaatctcctgacctcgtgatccgcccacctcagcctcccaaagtgctgggattacaggcgtgagccaccgcgcccatctggattacataaatttcctaatgcactcagagtcagcctgtatctataaacattagatttgctttttaaaagtacagttaaaataggcatcaaaccagtcagtaatttccacccagccttttcttttagagatttcaaaaattaagaaagaatattttccaaattttgagaagcact

SEQ ID NO: 379274 - DNA, 1691 bp, Homo sapiens
atttctttcgacaccgaagagaaggactgtataattgtgttattccttaattatttttcttctctttttgagtgatagaaattggccgctacaatgaagtctggaagtggcatcataagaacacaaagcaacattaatggagacagggtcattgtaggtagagttctcactgctttcaactaactgctgtatgtgctctccataaatcatgtcctccatatcattgataacctctaaattacatcagtcccgcttcctggatctcctctcccgatctggaattaaactgccctgcttaggcctcattttttctttattaggtgttaactgcctccagtgtcctctccttaaaaccattcaccaacttggctgggggtggctcacgcctgtaattatccggggggcccttttcagctctaaaattctatctaaaccatctttgtagatgttttttaagtaatgagttggtttaaaagtgaacaagggaagactgataaatttttctttttcacttttctgctgtcatatccgattggctaaaagtttttcttgacctgactttttgatctttaaaatgcagcagggtattgatgccaaggttttcactggactttgtaatttgagaagcagaaaatatggttatgcctttcaaaaacatctgcaaaggtttttgtttttgtattttttaaaatcttactcaagcttttcaaaacaataactttctggttcttagtggctatctcagacagttttacggaaaatatttcttacagagacagaaaggattcccacccagttaaatgtttcatcttctgtgatttgccctgcaaggagctcatctgtgtgttgagagggcatctagctttgggctccaattacaagagcagggccataggtggccatgctgcagggcactgctgttcagagggggctggccaaggaaaacactttcttgagcatttgaagcagaagatgaaacagatggtttttagctaggaaagcactcatgaacgtgtccccaagtaaatgttccatatgttaaatcctgactgcagtggaagcagcttgtcattaagtatgctacctgggaaatctccagtcaaacactccatacctgccattttatattctttgattggaaagccacacattaaatatggttctcaactttaaaagcagcactttctaatgcagacattaagtgcttgtggtaaaaatggaaatacaaacaaacctctttcatgttggctgaatcatcatcgttcttattatcatcaatagcaataggaaaaatttatatctcaccagtaaccctgctgttctttttggggtagagaagtagttatgaaatttaattcctgtcttcaagaaatttctaggctgggcgcagtggctcacgccggaaatcccaacactttgggaggccaaggcgggcagatctcttgaggacaggagttagagaccagtcgggttaacatggtgaaaccctgtctctactaaaacaaaaattagctgggcgtgatggagtgtgcctgtactcccagctactcaggaggctgaggcaggataattgctcgaacccaggaagtggaggttgcagtaagccaagatcgcaccattgcactccagcctgggcatcgcagcaacactccaaaaaagaaagaaagagagagcgagagagagagagagag

SEQ ID NO: 379275 - DNA, 1231 bp, Homo sapiens
ttctgtagccagtttaccacctgctgctgtgtgctgagttccagtaaaatcaccttgtctaaataagtgtatcatcaaggatccctcttttcagggactggataaaatggctacaagaactgtcccaggcagccagctcttcctgtataaataccacgtttttattcagttcttatttgaaaattgcgatttaaaaaactataattattcccttgggtacatgacaagtgtttttttggaaaagcaactttatttcctagcccattgccctgcccaaaagcatctggctgttccccagtgggatcgctctccccaaagagcagtgagggcttaaaagcatttttaggcagatactattaggggcgaagtctctctctgaagggaaacaaaatttttggttagttttctgaaagagaaaaagccaaaccctctgcttagctgggccaactgaatagtccacatactgcagtgacctctcatagttcaggaaaactgctgctgacacagaggaacacaaggccccctattaccttgtggctcatttaatgtgctacctgtaacatgctatgcatgcctctggaatatctttaaattctgaaccaagacccatgtattcctatttccatctgcaccagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379276 - DNA, 278 bp, Homo sapiens
catttttttgatgtttctcactctattaacaaaatacagcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtataaacatttgttacatctaaaatccacaacaggtaaacaatctgtgctt

SEQ ID NO: 379277 - DNA, 3290 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaagtttcttgcttccagttttgtgttatgatgtttgtacacgttccacaattatcttccttattaactttttaaagaaggtgtacttctgctatactttattcttaccatttaaaaacaaaaaattcccaaacattgttttgcacaactcttcataaagaaagagttttaatggtgccagacactgttaacagaagctttccacctgctctgcctgcctcttcacagctctgagttgtccagcctcactttgcctggtccctggccatccttaggacaagcagtctcctgcttagaacagggtgggcttccaagagttcctttggaagcaagttgcctgtaattcagaaatcattttcccattgacatatgggggaacctctagcccacatatgcttaatatttgacacaagataaatctgacatacctactacatttaatgaaatttttacagagaaggttgctcagattttcaattaggaatgcctatttatttcctccctctacagtcctggctgtgggcagaagcaaggccttcaccctgcttcccaacagggaaagtggggagtcacccacctagccccaagttctttgggtggctgcagtttttgtactgaagtcccagaggttagagaattaggagttttgaggaatgaggtgcaggggcctctaccatctgcacacttcagtcccagctggctcattctctttcctgacttctctctaccccggtgattggccagacttccttcctttgcactgtctacctgctaatcgacccagggtttccctcttccaaacccactggggaactaagagcagtccacaggattctccacatgcacttttgctctgaaacatgtttattttgattgttgacaatagtgatagatattcatgagaaagcgccttcgatatctcctccacctaccactttccatagcccctgaggaaaaccaaggtgaagagttagccttcaaggatcagggcaagctctaactggctgcttccccatatttgtaatagttcaaagtcttgaaatatcagcgcttaagagtctttgggagcataaactgagcttcgtattaacagcttcttcatttgctttaaaatagcgagacctcttaccttttcaatcccaaaactaaccacttataattcagtgtggtcatttaaacgtgtgtgtgtg

SEQ ID NO: 379278 - DNA, 1821 bp, Homo sapiens
gctggtacggccggaattaagggatgacaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379279 - DNA, 1778 bp, Homo sapiens
cggacgcgtgggtccggacgcgtgcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379280 - DNA, 1680 bp, Homo sapiens
taatctgtactcatgcgggcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379281 - DNA, 2172 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctaggactgtgaagatgatgagataccacaccttgattatgttacattaaatggcaaaagcaagattatccagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379282 - DNA, 1627 bp, Homo sapiens
ctccaagtgattccaaagatgctatcattatgagtgctacatgaagccgtattactacaaatgctgcctcagagttatagcgtgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379283 - DNA, 2280 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaatgaagaaacagaggctgaaagagtttaaagaatttggccggcacagtggctcatgcttgtaatctcagtgttttggaaggccagggcagaggattgcttgaggccaggagttcaagacaagcctggacaacatggcaatactccagctctacaaaacaataatgttaattagccagaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379284 - DNA, 1474 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtgattaaacacaaccgtctataatgtacagacccaactctcgcaagttccaggctctcctggggtgttcacatccatcatgtactatttgacaaatgtctgcttcaacaagctccctgtctcgcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtataaacatttgttacatctaaaatccacaacaggtaaacaatctgtgctt

SEQ ID NO: 379285 - DNA, 1350 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtataaacatttgttacatctaaaatccacaacaggtaaacaatctgtgctt

SEQ ID NO: 379286 - DNA, 1440 bp, Homo sapiens
tgatagaaccgaggtgatacctagctgggtgaaggcgtgaatagagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379287 - DNA, 1974 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379288 - DNA, 1279 bp, Homo sapiens
tcacgcatacttgatgaacccggcaggcgctaacacctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379289 - DNA, 1475 bp, Homo sapiens
tgccaaaaaaaaaaaacagtaggaaacagaacaccaacaagatacagcatccctcagcagaggcccacactagcctctgtctcctgcctttcctgggggaatggtgctgccagaatccacctgatggggagtagctggtttgagggcagaacaatagacgctgtcctctagtgctttgggatctagcatcccaggctcaggactcactaaatcagaaggaggtgtgctcagattcttagttttcatactgcatttatcttaaaggtcctgagacctcataaagcaatgtgtctatcttaccagaggttgatgggatctgttatcacctccacttaaaggaagagcaaatagatttttaggcagtttttcatgaaaatgtacctctgcctcctgttcccaactctcctgcatcccacaaaaagagcacacagaatggcatttttcctttgaattgtgaccttgtcttccaattctgccttacagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379290 - DNA, 778 bp, Homo sapiens
atttccctggtctgaggattcggcacgagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379291 - DNA, 1371 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctaggactgtgaagatgatgagataccacaccttgattatgttacattaaatggcaaaagcaagattatccagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccagcaaaaaatacatcccagaaaccgtcgggggctttattcggggggcgggacaacacgggttcgca

SEQ ID NO: 379292 - DNA, 1481 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379293 - DNA, 1455 bp, Homo sapiens
gactgctccttgacatttgtggacagggctctgggttcacctctgtcccagcatgtctgtcctgccactgagctggcaggcatttccgagggtgaagaaaaaagagagaagtggcaagagctggccctttataccacttccgatgttcctcccatgttactgggcatttttcaaacgttcatttcatttccaaatgtttagtgagggactcaattgctgccgcctcctggctttcagggcaggcaaggaagcggcagagatgtctgggcacacagtgtgaaggcagctttgctcaaacatgtcctagttgatcagttaattgatagtgattaaaaaccagctctgccttggggaattattactggttttgcgaagttctcaaaaacatcatcttcagtctctaactcccactccatctccccaccaaaaaaagagagagaaaaaaaatacccagtgatttccaaacctatcttcacattagaatcggggggaaggagatgagaagatcttttaaatgttccaaagtccaggccacacttcacaccaattaaaccacaatctctggtggagggacagaaatatcagtagttcttaaagcatccaggtgagtccgatgtgtagattgggctgggaatcaccaccctatcttattctcatactgcagtggcactattcaagatgctgggcccaataaaagagaccctttttacttagctgaaagcaagaaattagttgaccttgcttgctgcttctgtgaactttttgatccctaaaacaaaattaagattaggtttattcaatcacttccttctaaatatgaccttccattctaaagcaacaactcagcagaataccaaggaccctcaggaggacattgacatatttgttcactaaacagtgtgacaaaaatacagcttccttttgtctgtgcatcattatctcatgtcatacaaacattccaaatctgcattcagtgccaagcaataggcgaacactctcacaaactattaaaccataagtggaatattgtacctgttatttagaagcatatggaaaatgactattaataccctatgtattcttttcaataaggtgattaaacacaaccgtctataatgtacagacccaactctcgcaagttccaggctctcctggggtgttcacatccatcatgtactatttgacaaatgtctgcttcaacaagctccctgtctcgcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtataaacatttgttacatctaaaatccacaacaggtaaacaatctgtgctt

SEQ ID NO: 379294 - DNA, 418 bp, Homo sapiens
ctctgctttcattacaggggtaataagtgttcatgagaaggattggatgttcttaagagcagtcatcaacagttagtcaacaactagcgtagaaatgtatgacagcggaccaattgcaactctacagactcttttttctcttccagaatcttccccaggtgtgactgaggtgaccatcatagaaaagcctcctgctgaacgtcatatgatttcttcctgggaacaagtaagtgttgccacatgaactctacctcccatcaaagagaggtcagtgtaaatgtccctgagaaggaaagattaggggaggaagaatatttactcagaccacagctgctttcaaggtagagtttaccttttctatgttcctgttcagcccacttaacagttcctttcattctatgccacttacccagcatgg

SEQ ID NO: 379295 - DNA, 2103 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379296 - DNA, 1000 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaagtaagtgttgccacatgaactctacctcccatcaaagagaggtcagtgtaaatgtccctgagaaggaaagattaggggaggaagaatatttactcagaccacagctgctttcaaggtagagtttaccttttctatgttcctgttcagcccacttaacagttcctttcattctatgccacttacccagcatggagtgtttcccctgagccccactctcctacagaagcagtggacattcaaagttgtgtacaacaaagctaaaaatcaattaaggaaaagaaaggatatgtgttaataagtgtcatgctgtccagaacatgattaagtgttgcacataactactaagcagattaaaagctaatgctttccaactttcctctg

SEQ ID NO: 379297 - DNA, 2326 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaaaaaaaaacacaagaacaggacaaggagaacaagagatagaaaaaaaaaaaggggggggccttaaatatccagggggcaataacgcacacctttttgagagggcccaagggggttataaaggagggggtaaaagcgggagggaaaggtctggtttaggagcctttggggattggagccccagagtagcccgaaattgtgatggacctttggggttttttattcg

SEQ ID NO: 379298 - DNA, 1844 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaatcattctcatcatagcacattgagtatcatgggcgagatctatagacagatgacatcataccaga

SEQ ID NO: 379299 - DNA, 2265 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagggcaaggcactcacaggccaactccaaactcaagaagttggagaaatagactcacctctcaatgagaagtgctatgggcatgcagggaaggaaggaattgacagcacccacctttggagtaagctaccacagagagttttaatccacggcatatctaaagataatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379300 - DNA, 1707 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379301 - DNA, 1610 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379302 - DNA, 1889 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtaagggaggaacacctgccattgtaaactatggtatattccaaaatctactgaggaaatggttacattgcaggttcccaacttccctatctgattcaggagatctagggtggggcccaggaacctgcattttcaataagcaagacagatgattccaatggacagcctcactttactcatctagttaagtggttcccaaacttgactgattctcagaattaactggggagttttatttttaatgaaattctgttggatagtttatgtcccatgacttgttctgggttggcagtacatgcacccaggaagagtgaaaagtcagattctcactcccctgttctccaagtgtgcatccccagtggcagctgctattacgagtttcctgtacgcccttcccaagatactcattgcacataaagcatgcatgcacacttttggtgttccttttttctaaatctcaagtgtaatgtactgtcaacatgattctgcatcttgttcttttcacataacactccatcttggggcttattccctttcagtacatttagggcacttgtcctcttcagtggctacagagtattccattgtgtgggtgtgcctcatttatattacaggtctggtcaccatttcaggcatacagatgccaggtatacaacctggtttgaaaacaccaagtgtggctggaaaaacttttgactagaatgagctcatctgggctccttcgtggtggtttcttgcagctataaattagcagcaaattaggaactcagctccagct

SEQ ID NO: 379303 - DNA, 2206 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgttttcagcaaataaagaaaacatggagcttcctagtctgtatttacaccctaatcacagaagactagaaccaagcaagaagactgccaaattctcatcactgaagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379304 - DNA, 1551 bp, Homo sapiens
taatctgtactcatgcgggcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaa

SEQ ID NO: 379305 - DNA, 1546 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379306 - DNA, 1432 bp, Homo sapiens
cccctgtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtcggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgca

SEQ ID NO: 379307 - DNA, 562 bp, Homo sapiens
ttttttttttaacagaacaaagtagcttcttcctttatcattcctctacccctgaaccactacacagattgctttgtctttgtatttaacattccaggtcttattattgatgctttcggagagctaagagaccagcaggaacaagtacgagaagatatggaggtaatgttactctaactactaatcccagctctattttaatatccccagaagcaaatagattttttaaacaataggttttactattacttagggccagtactaagcaagaacgcagtttgttttccatgccctgttctctgcaccctgccatacccctgccaggccggccactctgctgcctcctccactgtcccacaataggagggagcagtatcctcagctaatcaggagctaagtgtatggcactactgagtgaatgactaatagccaatgtatggcactactgagtgaatgactaatagccaaaagcattagaaagaaagttttcattatccttcaattcgatagaatcatgacagttttctctcctgcctatattatgccaacaaatgccttttct

SEQ ID NO: 379308 - DNA, 527 bp, Homo sapiens
ttttttttttaacagaacaaagtagcttcttcctttatcattcctctacccctgaaccactacacagattgctttgtctttgtatttaacattccaggtcttattattgatgctttcggagagctaagagaccagcaggaacaagtacgagaagatatggaggtaatgttactctaactactaatcccagctctattttaatatccccagaagcaaatagattttttaaacaataggttttactattacttagggccagtactaagcaagaacgcagtttgttttccatgccctgttctctgcaccctgccatacccctgccaggccggccactctgctgcctcctccactgtcccacaataggagggagcagtatcctcagctaatcaggagctaagtgtatggcactactgagtgaatgactaatagccaaaagcattagaaagaaagttttcattatccttcaattcgatagaatcatgacagttttctctcctgcctatattatgccaacaaatgccttttct

SEQ ID NO: 379309 - DNA, 2027 bp, Homo sapiens
tagagcctgtgatgactctgaacttcaatcagatcttaaaattctttggtgagcaggacacaaaccagaaagatcccagatccaggcactcaaactgaaacgtttcttgatgtgttttccttgatgttaagaatgaagaaccaacctttttcgttttgtttttcagatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacagtgaagtgcccactgcaataaagtaatacgtaccaataaaaa

SEQ ID NO: 379310 - DNA, 1881 bp, Homo sapiens
  misc_feature (1)..(1): n is a, c, g, or t
nggtgattgataggcactgtggcaatttcctggcacaactgggtcgagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacagtgaagtgcccactgcaataaagtaatacgtaccaataaaaa

SEQ ID NO: 379311 - DNA, 422 bp, Homo sapiens
cttggttcaactccagccgaggagccttaggagtcctaactcattcaaccctggggctcatctaggcgtggcctgcacactagcatgggtcaaggagtctagtttgtattaatattagccatctaactgaaaacttaaagggtgacccaaatcagatcagctttaaagaggtaggtaggtatttagccaaagagattcatttggctttgatcccacaactaggcactctaagaattccactataaggagattgctgctctgaagttggaaggttaatttgtgacaaatacctgggagcaggagctttaatcacaaagcctgctctgagtaaccatcctcctcccactcctaggtgcctttggtggttttcaaaagggaaaaagaaatcgccaggaagctggagtttgatggcctatatatca

SEQ ID NO: 379312 - DNA, 725 bp, Homo sapiens
acagaacaaagtagcttcttcctttatcattcctctacccctgaaccactacacagattgctttgtctttgtatttaacattccaggtcttattattgatgctttcggagagctaagagaccagcaggaacaagtacgagaagatatggaggtaatgttactctaactactaatcccagctctattttaatatccccagaagcaaatagattttttaaacaataggttttactattacttagggccagtactaagcaagaacgcagtttgttttccatgccctgttctctgcaccctgccatacccctgccaggccggccactctgctgcctcctccactgtcccacaataggagggagcagtatcctcagctaatcaggagctaagtgtatggcactactgagtgaatgactaatagccaatgtatggcactactgagtgaatgactaatagccaaaagcattagaaagaaagttttcattatccttcaattcgatagaatcatgacagttttctctcctgcctatattatgccaacaaatgccttttctgcctgttatttttcttagactaaatgtttcatctgtgggattggcaatgactactttgacacaacccctcatggttttgaaacacatacattacaagagcacaacttagccaactacttgtgagtattcttggttaacaaaagtaatggcagctgtagcgtaaataaagccaat

SEQ ID NO: 379313 - DNA, 15575 bp, Homo sapiens
  misc_feature (2)..(2): n is a, c, g, or t
  misc_feature (869)..(869): n is a, c, g, or t
  misc_feature (1566)..(1566): n is a, c, g, or t
  misc_feature (2164)..(2164): n is a, c, g, or t
  misc_feature (2277)..(2277): n is a, c, g, or t
  misc_feature (7238)..(7238): n is a, c, g, or t
  misc_feature (7841)..(7841): n is a, c, g, or t
  misc_feature (10967)..(10967): n is a, c, g, or t
gngcagcagcagtcagcgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccagatctctgcgtctgcaattttgtgctggaacagtccctatctgtcagagccctgcaggaaatgcttgccaacacaggtgaaaatggcggcgaaggggcagcacaaggaggtggccacaggaccctgttatacggccatgcagttctcctgaggcactctttcagcggaatgtatctaacatgcttgactacatcaagatcccagacagacaaacttgcctttgatgtaggtctacgggaacatgccacaggagaagcctgttggtggactatacatcctgcttccaaacagaggtccgaaggagagaaagttcgaattggcgatgacctcatcctcgtcagcgtgtcctctgaaagataccttcatctctcagtatcaaatggtaacatacaagtggatgcctcctttatgcaaacactctggaatgtacatcctacgtgctcaggaagtagcatcgaagaaggatacctacttggtgggcatgtagtacgtcttttccatggtcatgatgaatgtttgacgataccatctacagaccagaatgattcccagcacaggaggatattctacgaagctgggggagctgggactcgagccagntctctttggagagtggaaccccttcggataagctggagtggcagtaacatcagatggggccaggctttccgactccggcatctcaccacaggccactacctggccttgacagaagaccaaggccttatactgcaagaccgggcaaagtcagacaccaagtccacagctttctctttccgggcatcaaaggaactcaaggagaaattagactccagtcacaagcgagacatagaaggcatgggagttccagaaatcaagtatggagattctgtctgctttgtgcagcatatagccagtggtctgtgggtgacctacaaagcacaagacgccaaaacttcccgcctgggacctctaaaaagaaaggtcatactccatcaggaaggccacatggatgatggattaacactgcagagatgccagcgtgaggagtcccaggctgctcggatcatccggaacactacagccttattcagccagtttgtcagtggaaacaatcgcacagctgcccccatcaccctgcctatagaagaagtcctgcagaccctacaggacttgatcgcctacttccagcccccagaggaggagatgcgacatgaagacaagcagaacaagctccgctcactcaaaaacagacaaaatcttttcaaggaagagggaatgttggcccttgtcttaaattgcattgaccgcttaaatntctacaatagcgtagcacactttgcagggattgcaagggaagagagtggcatggcctggaaagaaattctgaacctcctctacaaattgctggctgctctcattcgcggaaacagaaacaattgcgctcaattctccaataaccttgattggctcatcagtaaattggacagactagaatcttcctcaggtatcttggaagttttgcactgcatcttaactgaaagcccagaagccttaaatctgatagcggagggccacatcaagtcgatcatctccctgttggataagcacgggcggaatcacaaggttctggatatcctgtgctccctctgtctctgcaatggggttgcagtgagagccaaccagaatctgatctgtgacaacttgctgccccggagaaacctactcctgcagacacgactgattaacgatgtaaccagtatccggccaaacatcttcctgggagtcgcggagggctcagcccagtacaagaagtggtacttcgagctgattatcgaccaggtggaccccttcctaacagcagagcccacacatctgcgggtgggctgggcctcttcttcaggctatgccccatncccaggaggtggagaaggatggggaggcaatggtgttggtgacgacctgtactcctatggctttgatggacttcacctttggtcaggccggatacccagagctgtggcttccntcaaccagcacctcctgagatcggatgacgtggtaagctgctgcctggacctcggggtgcccagcatctcattccgcatcaatgggcagcccgtgcaggggatgtttgagaacttcaacacagacgggctcttcttccctgtgatgagcttttcagcaggtgtcaaagtacgtttcctgatgggtggacgtcatggagagtttaagttcctgcctccctctggctatgccccttgctatgaagccttacttccaaaagagaagatgagattggagcctgtcaaagaatataaacgtgatgctgatggcattagagatctcttgggtaccacccagttcctctcccaagcctctttcatcccatgccccgtagacaccagtcaggttattttgccacctcacctagaaaagatccgagacagactagctgaaaacatccatgagctttggggaatgaataaaatagaacttggctggactttcggcaagatacgagatgacaataaaagacaacacccttgccttgtggagttttcaaagctcccagaaactgagaagaactataacctgcaaatgtcaactgaaaccttaaaaaccctcttggccctggggtgccacattgctcatgttaacccagctgctgaggaggatctcaagaaggtcaaactgcccaaaaactatatgatgtccaacggctataagccagcccctttggatttgtctgatgtgaagctgttacctcctcaagaaattttagtggataagcttgcagaaaatgcacacaatgtttgggcaaaagacagaataaaacaaggatggacctatggcatccaacaggatttgaagaacaaaagaaatccccgtctggtgccatatgcattactggatgagcgtaccaagaagtcaaacagggacagcctgcgggaagctgtgcgcacttttgttggttacgggtataacattgagccatcagaccaagaactagctgactcggctgtggagaaggtcagcatagacaagatccgatttttccgggtagagcgatcttatgcagtgagatctggaaagtggtattttgagtttgaagtggtgactggaggagacatgcgagtcggctgggcgaggccaggctgtcgacctgatgtcgagctgggggccgatgaccaagcctttgtgtttgaaggcaacaggggccagcgttggcatcaaggaagtgggtattttgggcgtacctggcagccaggggatgtggtcggatgtatgattaacctggatgatgcttcaatgatcttcacactgaatggggagctgctgatcaccaacaaaggctctgaacttgccttcgctgactacgagattgagaatggcttcgtgcccatctgctgtctgggtctatctcagatcggccgcatgaatctcgggacagatgccagtaccttcaagttttataccatgtgcggtctccaagagggctttgagccttttgctgtcaacatgaacagagatgttgctatgtggttcagcaagcgcctcccgacgtttgtcaacgtgccaaaggatcatccacacatagaggtcatgaggattgatggcaccatggacagccctccgtgtctcaaggtgacgcataagacatttggcacacagaatagcaatgccgacatgatctattgccgcttgagcatgcctgtcgagtgccactcctccttcagccacagcccctgtctggacagtgaagctttccagaaaaggaaacagatgcaagaaatactctctcatacaacaacacagtgctactacgccatccgcatctttgctggacaggatccatcctgtgtctgggtcggatgggtgactccagactatcacttgtacagtgaaaagtttgacctgaataaaaactgcacagtgactgtcaccctaggggatgaaagaggccgggtccatgaaagtgtgaaacgcagcaactgctacatggtctggggtggagacattgtagccagttcccagagatcaaatcggagcaacgtggacctggagatcggctgtctcgtggatctggccatgggcatgttgtccttctcagccaatggaaaggaactgggcacctgctaccaggtggagcctaataccaaagtgtttccagcagtcttcctgcagcctacaagtacttctttgtttcagtttgaacttggaaagctgaagaacgcaatgcccctgtcagcggccatattcaggagtgaagagaagaacccagtcccacagtgtccacctcggctggacgtccaaaccatccagcccgtgctctggagccgcatgcccaacagcttcctgaaggtggagaccgagcgtgtgagcgagcgccacggctgggtggtgcagtgcctggagcccctgcagatgatggcgctccacatccccgaggagaacaggtgtgtggatatcctggagctctgtgagcaggaggacctgatgcggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccccattaccagcaccaccaggaatatctgcctcttcccggacgagtccaagaggcatggactgcctggggtgggcctgagaacatgtctcaagcccgggttcaggttctccaccccttgctttgttgtgactggtgaggatcaccaaaagcagagccccgagattcccttggagagtctcaggacgaaggctctgagtatgctgacagaggcagtgcagtgcagcggggcccacatccgagaccctgtaggggggtctgtggagttccagtttgtgcctgtgctgaaactcattggaaccctgctggtcatgggcgtgtttgatgatgatgatgttcggcagatcctcctcctgattgatccctctgtgtttggggagcatagtgcggggacagaggagggagcagaaaaggaggaagtgacccaggtggaggagaaggctgtggaggctggggagaaggccggcaaggaggctcctgtcaaaggcttgttgcagactcgattacccgaatccgtcaagctgcagatgtgtgagctcctcagctatctctgcgactgtgagctgcagcaccgagtggaggccattgtggcatttggtgacatttatgtctccaagctgcaggcaaatcagaagttccgctacaatgagctcatgcaggccctgaacatgtctgcggccctgactgcccggaagaccaaggagttccgctcacccccacaggagcagatcaacatgctgcttaactttcaactgggagagaactgcccctgcccagaggagattcgggaggagctgtatgatttccatgaggaccttctccttcactgtggggttcctttggaagaagaggaagaggaggaggaggacacctcctggacaggaaaactctgtgccttggtttacaaaatcaaaggcccacccaagccagagaaggagcagccgacggaggaggaggagagatgccccacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggagacataatgaacaacaaggtgttttaccagcatcccaacctcatgagagtcctgggcatgcacgagacggtgatggaggtgatggtgaacgtgttgggtacagagaaatctcagattgcatttccaaagatggttgctagctgctgccgtttcctttgctatttctgtcgaattagccggcaaaatcagaaggccatgtttgagcatctgagttatcttctggagaatagcagtgttggcctagcctccccgtcgatgaggggatccaccccgctggatgtggcagcttcctctgtgatggacaacaatgagttagcgctgagcttagaggaaccagacctcgagaaggtggtgacctacttggcaggctgtggcctacagagctgccccatgcttctggccaaaggataccctgatgtcggctggaaccccattgaaggggaacgctacctgtccttcctgaggtttgctgtcttcgtgaacagtgagagtgtggaagaaaacgccagcgttgtggtcaagctgctcatcagacgcccagagtgcttcggcccggccctgcggggtgaggggggaaacgggctcttggcagccatgcagggtgccattaagatctctgagaacccagcgctcgacctcccctctcaaggatacaaaagagaagtcagcacggaggacgatgaagaggaagaagaaatcgtgcatatgggcaatgcaattatgtcattttattcggcccttatagatctactgggccgctgtgctcctgaaatgcacctcatccagacaggaaagggggaagccatccgcatcaggtccatcctgcgctccctggtccccacagaagacctggttgggatcatcagcatccccttgaaactgccctccctcaacaaagatgggtcggtcagtgagccagatatggcggccaatttctgccctgaccacaaggcacctatggtgctgttcttggaccgcgtttatggcattaaggatcaaacttttctgctccacttnctggaggttggatttttacctgacctaagagcttctgcctctctagatacagtttccctaagcaccacagaggctgcgcttgcactaaataggtatatatgttctgctgtgctcccgctcctcacaagatgtgcccctctctttgccggaacagaacactgcacctctctgattgattccacactgcagacaatatacaggctatccaagggacgttccctcaccaaagcacaaagggacactatagaagaatgtttgcttgccatttgcaatcacttgaggccttccatgttacagcaactcctgcgacgcctcgtttttgatgtgccgcaactcaatgaatactgcaaaatgcctctcaagcttctgacgaatcactatgaacagtgttggaagtattactgcctgccttcaggatgggggagctacgggctagctgtggaagaagagctgcacctaacggagaagcttttctgggggatttttgactcgctctcccataagaaatatgacccagatcttttccgaatggccctgccttgtctcagtgctatagctggggccttgccaccagattatttagataccagaatcacagccacnttggagaaacagatctcagtggatgcggatggcaactttgacccaaaacctattaacaccatgaatttttccttgcctgaaaaattggaatacatcgtcaccaagtatgctgagcattcacatgataaatgggcctgtgacaagagtcagagtggatggaaatatgggatttccctggatgaaaatgtgaagacccacccactgataaggcctttcaagacattaacggagaaggagaaggaaatttatcgctggcctgcgcgagagtccctgaaaaccatgctggctgtgggctggactgtggagaggaccaaagagggagaagctttggttcaacagcgggaaaatgagaagcttcgaagtgtgtcccaggccaaccagggcaacagctacagtcctgctcccctcgacctctcaaacgttgtgctctccagagagctccagggaatggtggaggtcgtggctgagaactatcacaatatctgggccaagaagaagaagctggagctggagagcaaaggtggtggcagccaccctcttctggtaccatatgacaccttgactgccaaggaaaagttcaaggaccgggagaaggcacaggacctgtttaagttcctccaagtgaatggcatcatagtttccaggggtatgaaggatatggagctggatgcctcctccatggagaagaggtttgcctataagttcttgaagaagatcctgaaatacgttgattctgctcaagaatttattgcccatttagaagccattgtcagcagtgggaaaactgaaaagtctccccgtgaccaggagatcaaattctttgccaaagttctcctcccgctggttgaccagtacttcaccagtcattgcctctacttcttgtcatcccctctgaagccccttagcagcagcggatatgcctcccataaggagaaagaaatggtggccggcctgttctgcaaacttgccgctctcgttagacacagaatttccctctttggtagtgattctactacaatggtgagctgtcttcacatcttagctcagacacttgacacaaggactgtcatgaagtcaggctcagagctggtgaaggctgggttacgagcattctttgaaaatgctgcagaagatttggagaagacttcagaaaacctgaaacttgggaagttcacccattcccgaacgcagattaaaggcgtttctcagaatattaactacactacagtggctctgctccccatcctgacgtccatctttgagcacgtcactcagcatcagtttggaatggatctactcttgggtgatgtgcagatttcatgctaccacatactgtgcagcctctactcccttgggacgggaaagaacatttatgttgaaaggcaacgccctgcccttggagaatgtctggcctcgctggcagctgccataccagtggcattcctggagcccacccttaatcgctacaatccactctcggtcttcaacaccaaaacccccagggagaggtctattctggggatgccagacacggtagaagacatgtgtcctgacatcccccagctggaaggcctgatgaaggaaatcaacgacctggccgagtcaggggcccggtacacagagatgccccatgtcatcgaggtgatcttacccatgctctgcaactacttgtcctactggtgggagcggggtcctgagaacctgccccccagcacagggccatgctgcaccaaggtcacctctgaacacctcagtctcatcctgggcaacattctgaaaatcatcaacaacaacctgggcatcgatgaggcctcctggatgaagcgcattgcagtgtatgcacagcccatcatcagcaaagccaggcccgacctgctgagaagccacttcatcccaactctggagaagctgaagaaaaaggctgtcaagacggtgcaggaggaggagcagttgaaagccgatggcaaaggggacacccaggaggcagaactcctcatcctggacgagttcgcggtcctctgcagagatctctatgccttctaccccatgctgatccgctacgtggacaacaacagatctaactggctgaaaagtcctgatgctgattctgaccagctcttccgcatggtggcagaagtcttcattctgtggtgtaaatctcataacttcaagagagaagagcaaaattttgtgattcagaatgaaattaataatttggcatttttaactggagacagcaaaagcaagatgtcaaaagccatgcaagtaaagtctggaggacaagaccaggagcggaagaagacaaagcggcggggagacttgtattccatccagacctccctcatcgtggctgcactcaagaaaatgctgcccattggtttgaatatgtgtactccaggcgaccaggagctgatctccctcgcaaaatcgcgatacagccatagggacacagatgaagaggtcagagaacatctgcggaacaacttgcacttgcaggaaaagtctgatgacccagctgtaaaatggcaactgaacctctacaaggatgttctgaagagtgaagaacctttcaatccggaaaagacagtggagcgtgtgcagagaatttcagcagctgtcttccacctggaacaggtggaacagcctttgaggtccaagaaggccgtctggcacaaactgttatcaaagcaacggaaacgggcagtggtggcctgtttcaggatggcccctctctacaacctgcccaggcaccgctctattaacctcttcctccatggctatcagagattttggatagaaacagaggagtattcctttgaagagaaactagtacaggatttggctaaatctccaaaggtggaagaggaggaggaggaagagacagaaaaacaacctgacccactacatcagatcattctctattttagccgcaacgctctcacggagaggagcaaattggaagacgaccctttgtacacctcctattccagcatgatggccaagagttgtcaaagtggtgaggatgaagaagaagatgaagacaaggaaaaaacattcgaagagaaagagatggagaagcaaaaaaccctctatcagcaagctcggctgcatgagcgtggtgctgcngagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacagtgaagtgcccactgcaataaagtaatacgtaccaataaaaa

SEQ ID NO: 379314 - DNA, 4779 bp, Homo sapiens
  misc_feature (171)..(171): n is a, c, g, or t
tttaatttgattgtctgtcttctcccttccctgctccatgaaatccagagttgtcaaagtggtgaggatgaagaagaagatgaagacaaggaaaaaacattcgaagagaaagagatggagaagcaaaaaaccctctatcagcaagctcggctgcatgagcgtggtgctgcngagatggtccttcagatgataagcgctagcaaaggtgagatgagccccatggtggttgagacgctgaagctggggatcgccattctgaacggaggcaatgctggtgtgcaacagaaaatgctagattacctaaaggagaaaaaggatgctggattctttcaaagcctttctggtcttatgcagtcttgcagtgtccttgatttgaatgcatttgagaggcagaataaagctgaaggcctggggatggtgactgaagaaggaacactcattgttcgggaacgtggtgaaaaagtactccagaatgacgagttcacgcgtgatctctttagattcctacagttactttgtgagggacataacagtgactttcagaacttcctgcggactcagatgggcaacaccaccaccgtgaatgtcatcatcagcactgtggactaccttctgcgtctgcaggaatcaatcagtgatttctactggtattattcagggaaggacatcattgatgaatctggacagcacaatttttccaaagctctggcagtcaccaagcagattttcaattctcttacagaatacatccagggcccttgcattggtaatcaacagagcctggctcacagcaggctgtgggacgcagtggttggcttcctccatgtctttgctaatatgcagatgaaactctctcaggattccagtcagatcgagctgctgaaggaactcttggatctccttcaggacatggtggtgatgcttctgtccctcctggaagggaatgtggtaaatggcaccattggcaagcagatggttgacacactggtagaatcatctaccaatgtagaaatgatcttgaaattctttgacatgttcttgaaacttaaagacttaaccagctcagacaccttcaaagaatatgacccagatggtaaaggaattatctccaaaaaagaattccagaaggccatggaagggcaaaaacagtacacgcagtcagagattgactttctcctgtcgtgtgcagaagctgatgagaatgacatgtttaattacgttgattttgtagaccggttccatgagccagccaaggacatagggtttaatgtggctgtgttattgacaaatctttctgaacacatgccaaacgattcccgcctgaagtgtctgttggacccagcagaaagtgtgctaaattacttcgaaccctacctaggacgcatcgagatcatgggtggggccaagaagattgagcgtgtttattttgagatcagtgaatccagtcgcactcagtgggagaagccccaggtgaaggaatctaagcgacagttcatttttgatgttgtcaatgaaggtggggagcaggaaaagatggagctgtttgtgaacttctgtgaggacaccatctttgaaatgcagttagcatctcagatctctgaatccgattcagctgacaggccagaagaggaggaagaagatgaagattcttcttacgtgttagaaattgcgggtgaagaggaagaagacgggtctcttgagccggcctctgcatttgctatggcctgtgcctctgtgaagaggaatgtcaccgacttcctgaagagagcaaccctgaagaacctcaggaagcagtacaggaacgtgaaaaagatgactgcgaaggagctggtgaaggtgctcttctcctttttctggatgctgttcgtggggctattccagttgctcttcaccatcctgggaggaatctttcagatcctctggagcacagtgtttggagggggcctggtagaaggggcaaagaacatcagagtgaccaagatcctgggtgacatgcctgacccaacccaatttggtatccatgatgacactatggaggctgagagggcagaggtgatggagccaggtatcaccactgaactagtacacttcataaagggggagaagggagatacagatatcatgtcagacctctttggactccacccaaagaaagagggcagcttaaagcatgggcctgaagtgggtttgggtgacctctcagaaattattggcaaggatgaaccccctacattagagagtactgtacagaagaagaggaaagctcaggcagcagaaatgaaagcagcaaatgaagcagaaggaaaagtagaatccgagaaggcagacatggaagatggagagaaggaagacaaagacaaagaagaggagcaagctgagtacctgtggacagaagtgacaaaaaagaagaagcggcggtgtggtcagaaggttgagaagccggaagctttcacagccaatttctttaaagggctggaaatctatcagaccaagttactgcattacctggccaggaatttctacaacctgaggttccttgctctgtttgtagccttcgctatcaacttcatcctgcttttttataaggtcactgaagaacctttagaagaagagacagaggatgttgcaaacctatggaattcctttaatgacgaggaagaggaagaagcgatggtattctttgtccttcaggagagcaccgggtatatggcaccaaccctgcgtgccctggccatcatccataccatcatctctctagtctgtgtggtgggctactactgcctgaaggtgcctttggtggttttcaaaagggaaaaagaaatcgccaggaagctggagtttgatggcctatatatcaccgaacagccatctgaagatgacatcaaggggcagtgggaccgcttggtgatcaacacaccatcttttcctaataactactgggacaagtttgtaaagagaaaggtgatcaacaagtatggagatctctacggagcagaacgcattgctgaacttctgggtttggacaaaaatgctcttgactttagcccagtagaagagaccaaagcagaagcggcttctctggtgtcatggctaagttccatagacatgaagtaccatatctggaagcttggagttgtttttactgacaactcctttctctaccttgcctggtatacaaccatgtcagtcctgggccactacaataacttcttctttgctgctcacctattggacatcgcaatgggcttcaagacactgaggaccattctgtcatctgtaactcacaatggcaaacagttggttctgactgtcggtctcctggccgtggtggtttatctctatactgtggtggctttcaacttcttccgcaagttctacaacaaaagcgaagacgatgacgagcccgatatgaagtgcgacgacatgatgacgtgttaccttttccacatgtacgtgggagtgagagcaggaggtggcattggtgatgaaattgaagaccctgctggtgatccttatgaaatgtatcgcattgtctttgacattacctttttcttcttcgtcattgtcatcttgctggccatcattcaaggtcttattattgatgctttcggagagctaagagaccagcaggaacaagtacgagaagatatggagactaaatgtttcatctgtgggattggcaatgactactttgacacaacccctcatggttttgaaacacatacattacaagagcacaacttagccaactacttgttctttctgatgtatttgattaataaagatgaaacagagcacacgggtcaggaatcttatgtctggaagatgtaccaagaaaggtgttgggatttcttcccagccggtgactgctttcgtaaacaatatgaagatcagcttggataaatctgaatcaaagaagcgcgacaattctggacagtcaacttcccatgaaataaagtcccctttttacagttctgcaacatatctgaaatgtgacattttctaaatgcctcccttaaaaaaaaaactgctgaaaatctgtgctattttgaaattgatttggctttttgtgcctaatggacatacactgtgggagagaacctgtcaaaatgtcgaagaaggaaggcgaagaatcaagtaatctctaggcaaatgccttcaagttttccagttctgaggtaactagttcagtttgttgggatggaagcatgaaggaaagggctagagaagtatgaaatctcgaatgtgtaatacctgaaaatttaaacacttgaatgtcatcatggtatccaacttgtgactcatagggtctgaactccaaaagataataactgcagtctaatttttcccatggtacttgctagtgactgtatccagaaaagctttaagcagttaaagaaacagaaaaaaaccgacactttgtcgacactgaaatatcgattaagtgccttaaaacctctttagacatagctatgcaagttttttatgtttgtgttccagaaggacagttccattcattagttgtgatcttccgtcttactttatgaaactgcacttgaaggttattcatacaagtttttttagtaacagctgtcagtcaactgctgttattagaagaaaagtactgtactgaaaattcagaaaaaaaatctcaaccttatgccaaaatggagtaatgctttatggtcccttgtaagtagtggagctgctctgtttaggtgaatctcctcaaatacagtgaagtgcccactgcaataaagtaatacgtaccaataaaaa

SEQ ID NO: 379315 - DNA, 2325 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379316 - DNA, 2478 bp, Homo sapiens
tgaggcagaggcctccctcccaccccagctcttggcctgtggcccaagtgcccctttttgggggtgagagggaaccaatataatggcagtgtctggtggtctgcccggccactggatgctttacaaacatgacccagtagcagtcccagctcgagttctcatggccttttgagagacgacattgatgcttgtggaggtcacagttaggaaagagcgggctgggatttgaacccagggctgaccaatcccaagcatagccaaggcctccttacctggctccctgagaaactggggagcagaggcccgctcctggctgggagcgtttgccgagcagcttgtgctgagccaagtggcacggacaatctgccacccaagggtcttcaccctcccgctcccctcccgcagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379317 - DNA, 193 bp, Homo sapiens
ctggaacctctctgattggtgtatacatcgccatgtggtatgaggaagcggctcccagcggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379318 - DNA, 3619 bp, Homo sapiens
atgactcggggagccagactgcgatcagacgcgcgtgcccagctgaaccaggtgcgtgagaaggctgccttcaggtggccgggggctccctccagctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379319 - DNA, 3675 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtgctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379320 - DNA, 3675 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaaggtgaggtgcaggggtgggaaagggtgaggggctgacaccctggaccctcctgctaatccccacccgtgtgccctgtgcccagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379321 - DNA, 2407 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtgctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379322 - DNA, 1142 bp, Homo sapiens
atgactcggggagccagactgcgatcagacgcgcgtgcccagctgaaccaggtgcgtgagaaggctgccttcaggtggccgggggctccctccagctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagatgcttgagcccatggggcactccccaatgacccccattgacccaccaccctttgtccccaaacctggggggaccccaaaacccctttcgttcctttgccacttccccttgtggacagcccgcctgtgaaggaaggcttccgagagagatcg

SEQ ID NO: 379323 - DNA, 3575 bp, Homo sapiens
atgactcggggagccagactgcgatcagacgcgcgtgcccagctgaaccagctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379324 - DNA, 3785 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtggtgagggggccctggaggggctggcctgggggagatgcaggccagaacacacaggtccctgagtgttgggctgaggagcctgggctgcaccccaggaaggggagagacagctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379325 - DNA, 3575 bp, Homo sapiens
atgactcggggagccagactgcgatcagacgcgcgtgcccagctgaaccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaaggtgaggtgcaggggtgggaaagggtgaggggctgacaccctggaccctcctgctaatccccacccgtgtgccctgtgcccagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggcacacgcccctgcccacgttcattgcggccaacacaagcaccctgtgccggttccaggggcacaggtgacctgggccttacctgccacccgtgggctcaaatccactgcagcagacagacgggatggaaatcattaggactccatgttgctctgcacggccgagtgacacgaagaggcaggcggagggagctgtgaggcttacttgtcagactcaggaaggagcaacatgagggcccaactggagacccggaggcccgagctgggaggaggcagtgggggcggggtgcaggtggaagggatttcagagacaccctcgtccaaaacacttgttccctgctgaaactccaacaatttgcagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379326 - DNA, 2101 bp, Homo sapiens
ggttggggccattcagggctgtgggcccatgtggactggatgcccagcgtgagtgtataccgtgagggcctttgagctctcggacagcgtggagtggtcaaggaaggcctccaggaggaagaggtggccaaccgccccaggcagcacagtgctgtctctggacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaaggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctctgctcctgctcctggcgccatcctaggagccagccatgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcaggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcacgaaccttattctccaaaacaaaagcaacaaggactttgacttctcagcagcactcagctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaatttaaaaatcaaaaacccatgc

SEQ ID NO: 379327 - DNA, 530 bp, Homo sapiens
ctcttttttctttctcattaggattactctgcccctcagcggttccagtgccctcaaagcaatctgtctctgaagtactggctatcttctgagcgtgtgccagaagatccagctttgttgaaaagcgaagccgttagtcccttaatacaaaggagacaaattgatttatgcctggggcaccatcaccaaaagaagaggaaatggatgcaagccttcccagaacaacaggtgcagtaaagaagctggccaaaacccaccaaaaccaagatggtgaagagagtgacctttggttgttttcactgctacactccgaccagcaccatgacagtttacaaatgctacagcaatgtcaggaagctaccccatacagtctaaaaaggggaggaatgaataatcgaccccttgtttagcaaatcatcaagaaataaccataaaaatgggcaaccagcagccctcagggctgctctgcctatggagtagccattcctcttattcttttactttcttaataaacatgctttcactttaaa

SEQ ID NO: 379328 - DNA, 1931 bp, Homo sapiens
tggccggctcgggattccgggctttcttcccgagaccgcgtcccccagctgggccgaaggtggacgctcaggggctggaggctcagcggaatcccctgcgttcagtagccccgctctcccctgtcccgaaggattactctgcccctcagcggttccagtgccctcaaagcaatctgtctctgaagtactggctatcttctgagcgtgtgccagaagatccagctttgttgaaaagcgaagccgttagtcccttaatacaaaggatcagggatagcagaaatgaaagtataatggaagcagctggaggattccaggtccactttcacccaagtaatggagacggaaggttcatcgaaacttcttcagctgcagatctagaagtcattagctattctagcaaagtatctgtcacagaaaggtgcttcataaaggtctgcactgtgctcttttgacctgtgtcttcaagcatgtgctgtcataacagattaaagatgactgaaaattatctgccactcattgcgtgaaaggtgggatctgtagacctccctcttgaatttgggagggttctgtgactgctgtgaccaatgaatatggcagaagtgacgctttgccaacttctgggtccaggctatacgagacaggcagttccactcactgtctcttagatccatgtaaaaagttcatctaccctgctggaaaaaccatgtagagaggccctgagactacattgggtgggagaggggctcagctgcaccatcttccaactgtccccatcaagatgacagaaatataaatgaagccttcttgaactccagaccatccatgctacaagctaaatgccaccaagcgaccccagttaataccatgtggagcaaaaatatcacttaaccaagcactgcctgagtttctgaccccacagaattctgaccccatacaaataaaataatttttgtaattttttataattcgtcatgtaatagataaatggaacagccttcttccagtcttttaaatagctgcaagaaatcttattcaagcagaaggaagtttctactttgttcatacagtctcaagacatccctggagcctttcaagggaaatttgggcagaagtaggtagagaggtaaagctattatgtaacattacttaacatgattaaaaccaccttaatgtctcccatcctcaaaggctgccagtgaattggaaattaatggattaaatgaggacagagaaactagtatttgtgcatatgcactgtgccaggtatttaacgtatcttagctcatgtggtcttcgaaacaaccccatattgtagtatcaggctcacacgggtaactaactagtgcaaagacacaaggctcacaaactgctacttgaccctagagctctttgactccgattcccatgtacgtgccccaataccatgttgactcccaaggtgtaaatcttcaggtatacaaactattaaaatgtgaattttcatttatacgcaatttttgcttatgatatgttttttgtcacttgcataataatagatatgtaactttaaatcagcaatattatactggctatcaaccagtttcatgtaaatttttctaacagaaagaatgtagcattgaaatgtgtacatttttgtccaagtacacctggcaattgaaagaaaaaatccaagccacttggatgcttgattttgtgatttttttttatacacttccttataagaattttttttaggtattgaatttgcaactacaaaacctgattttcctcccggttctgtccctttctagtaatgagacattggacaagtcacttcacttcccagagctttagtttcctcactagttagtggaggccaagagttagctctaagagtgtgagaattattaataaatgagataatgtattttaaaatatttttaaactacaaa

SEQ ID NO: 379329 - DNA, 415 bp, Homo sapiens
ccctatggctgctctctggaatctttttcaccctctgggttcctcatctccccctttcggctccccagcttcaaaggtgccccgccaggaattgtacgtgcagacccccagcttaaaggcaggcggccacacccggccagcgagtgtcgcccaggcacctgcttctgtcgggcggacccacccttccaggcggttccggcgcgctgtgcctccgcaggctgctcactaagagcgcggcggcctggaacccagtagcgcgcgggtgtggtgagcgctacgcttctcggcgtctgccaggacagggtcggggatctagagatgccgcccaggaggtgttgggcgccaggggaaagagaagagcctggcacggaagagacaaggtcttctctgttgcagctgcagcagctaggtagcc

SEQ ID NO: 379330 - DNA, 3502 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaaggtgagcagtctgggtcggtagcgaaagcggagaccttagctgaccccgcagctgtctttctctttgttaacctcaacacatcgcgcccccttccgggaacacttgctcttctctccttggcttaactagtcccggtttttcattctttatccgtgacctttagggaaccgtgggggggaagtctggtttccgtcctgctgctttccttcaactacaagatggcttctcaaaaggacgcatgcaatgccattcctcaaagacagtatgttgatttcacagtgtttttatatgaacaacgttcaagtgtcaaaagtatcaatttccaggctaggagctacaagttaaaaggaaaacaaaaatgttccaaagatacagtgtttattagctacatcttgggaagtgcctttccagagagtaacatgaaaacttctgcgtgacaaagtgcacgaagtatctgaattatttcattgggcaattgtcgtgcaaaagaaatagcaaattaccgtagaaacaaaatagtaagagcacagctagatggataaagatacagatgtgaaaatatagatgccctttgcatgaaaattcagttttcctcagcactagagacccagatactcctgaattagcattataataaagtcgtcactagctaaccatctgcctttcctccaatccacggacgtggtcctcaaaataacattttatcttgtgagaaaccttcattaattacacctaacaacaccatgacgcaggttcatgaggatactactgaaggcaaaaggaaatccctatttctctgaccctttccctaatttccacttagcacaaataagactactggacagtctgattttaaaaaatcactgtatgggccgggcttggtggctcccgcctgtaatcccagcactttgggaggccgaggcgggcagatcacttgaggtcaggagttcaagaccagcctggccaacatggtgaaaccccgtctctactaaaaatacaaaaattacctgggcgtggtggcaggcgcctgtaatcctagctactaggggggctgaggcaggagaattgcttgaactcagggtcagaggtcgcagtgagccgagatccctccactgcactccagcctgggcaacagagtgagtctctgtctcaaaagaataaaataaataaaaaccactgtatggagcaaaaactagaaggacatataccacatgttatcagtaatctctaattttgctctgtgattttgtgcattttccaagttttttgcatcaggtctgattttcaagtttaattctctgagaaacattctcatcagaggaatgttctatcttcttagagaaacctgattggcctagtgaaactgtcatgttcctactctctataatcatattgtaattctttgcttgtttccctagtaaaggtgaggcaattttcgggtaagggatttccccctcacctctgccctccaagtggccagcatctgctttgcacacagaaatttttacatctgctatatgtttgcattaatatgttcaacaatgatcctaatgtaggccagtcattttggaaatgcattgtgaagtggagaggattattaaatacctcacattttgttccttgtgccagtttaatgagacaccctcagcaattgctatttaccagaccagaaaatgaattttacagttccaattccagttccctttctctaaccactctgttctaagagttccccgtaacattatgatcttatggacacatcaggtaagtgtatgtatttcaacacagaattttctaagaatgtgtgttgtggtgttaaatttctatgtaagcagctgtcacgtgcatgatctgctgcagtttgatcatcctgcgcctggatcatcaaatgcttagcagccatcattttaccagtcttatctgacaatctgctgttaatgactaacaaccaggggactttataggttaaaatttttattaacttcctctgttttcagtgtttaaagtagaaaatttggccaatgtggctcacgcctgtaatgccaatactttgggaggccaaggagggtggatcacctgaggccaggagtctgagactagcctggccaccatggggaaactgcctacaaaaaaatacaaaaattagctgggtgtggtggcccagctactcaggaggctgatgcatgagaatcacttgaacccgggaggtggaagttgtagtgagccgagatcgtgccactgcattccagcctgtgctacacagcgagactctgtctcaatgaatgaatgaatgaatgaatgaatgaatggagtgaagtagaaaattctaggggaggacatgtcaccttccattattacagaaacaaattatccttaaagcaaaatggaaataagctaagtaagatgatatgtggaaaatatatcgaaataggaactattgctgtttcttgagatttgaacctttatagtgttattaggtgccatatcacatccatcttaaaacctaataaaaatttaaagctgtggtatat

SEQ ID NO: 379331 - DNA, 1832 bp, Homo sapiens
aatttcgggagggaaaatcgaggcacacagaggtaaatcacttgcccagggtcacaaagtagagtaaaactaaggggtagggatgcccgcgggagtcatttaagaacttaaacttaggaactaaaacattttcaaatgtggggaaatttcactttcaagaaagctagaaatgaaccacctcacagtatcaaagactagaatatttatgtttttaaaagtaatctgaattctcgttttttttgtttgtttgttttaaatgagggactcattctgtcacccaggctggagtgcagtggcgtgatcacagctcattgcagtcttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcacataatcaatattttatcattttatatttggaaaaaaacgggaagctggggtaaaccagtttctaaataaagctaatgaaactttaattcattcaaacactatggtagttatgttgatgataagtaaacattattatttatttatactgtttcctgaggtgatccagaaactactgttattatagtagacttgctactatatacatttactatccctgcaaatgtgctttggaaataataacaaaaattttaaggtagacccatgtgtaatttaacatgctttctctgttacaaaagctatctttaggaaattcttaagtatcaaaaatccaatttattccattttcagaagacaaggaaaaagcactcataaactctaggccataaaaaaataggtttcataagtagctcctttaacatgaagaaaatgacaataaaaatatcttacttgcatgttacttctggaataatgtcaaaaatctatgtagatctttccattttaaatgatgttaaaatagtgtcagcactgtgactgactcatagcaagtatgggtatctatccaaatatttgtctttgaaacaagaaacaagtgaccatccgatgaaaagtgcatgcctcttaacagtatctttctgtaagaaaaattaggtgatctatatttacatttgggcagtggggggatgaaaactgctcttaccaagatggctgacttgaataaagacagtcaatatttttcaaaaaattcactgctctggtactgagatctccatgataacagattacagttaaacagaaaatgctgtgaaataccttttacagaacacagcctgactttgcagattaacttaaagatatatttcttgattatttcactgttaaaaatcaagaaaaacactactaacatttcaacatcttaaaaatagaatttatgcaatgacatttttaagctctgcattttgtatactattaccgtctttaattacagttatgttcatccatatatcaaaaggcagcactggtaaccttgataacattatatatgcttatgtgtttaagacagtcttgattaaatatttccataccttatctgcagccactattcttatcctttcttcccaggaggagaatgaagtgggactaggcatttacctggcacttgcctgcactatcattcattggcactaatgattaggatgcttgaaccatgcagttttgtttctatttcaacaatatgacactgaagtagccattatcttttgatatttaagcctaagtaatagtatattcttcatgccaagttttgacagctcaataatttgtattctagaggggaaaaatgatatttttgctattattt

SEQ ID NO: 379332 - DNA, 4339 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccagaatgtttgttgcagatacagttccaccactctacattaagtatgtggaaaacagaagatatccttttggttcctgggtctccagaacagtaggagcaaacatccaaatctgatatagcacttccagagagcctggtcttggaggataaaactttaccttgatgggacttttggccccggtcccttaagagttgggatttggggttgtactgcagcacaactcagcctatcctaatacatatgggaatgcaaacatctcagatatttcttcttgggtgcaatttaaaatacgtatgaaatggcttcagaagtgtccatgaaccttcaaaattacatacaagaattagggagatacatttttctgggaacatacagatgttaagacttcccttctccgtctctatattgccagaagagagggccccagaattaaaaccccatccttcctacaacactcagctttctctttcaggaatatcagtactaatatcaccatgccttttatctctaggatatcttcatcccctgtaccttaatttctgcatgacttcatagggagtccatattgcttgatttttctccatatcattaccattgacataaattttccttacattcttagaatgtgtatttcctcacctttttagatttcctggctcttatgttgactgctgtatccctagtacctaccacacaacaggtattcaacaaatacttttttttttttgagacagtctctgtcacccaggctggagtgcagtggtactatcttggctcagtgcaacctctgcctcccgggttcaagcgattctcctgcctcagcctcccaagtagcagggattacaggcctgtgccaccatgcccagctaatttttgtatttttagtagagatgggtttttgtcatgttggccaggctggtctcgaactcctggtctcaggtgatttgcccactttggccacccaaagtgctgggattacaggcatgagccactgtgcctggcctaaaaaatacttactaaatgactaaacaaataaaagatagtctctaactttcatcataatctcaaagagcttcatgatctggaagaagtttagacacaaatgggtaggcaaagtatttcttaattgctggtgcaagaccttacccttgtcttaataattatcctgtctaagtaatacaccttttaagaaacccctgaaaggaagatgatcgtccttggtagatactgaaatctgaggtaaagtggcccataaactgttttgaaatagagaatttctaaaatatgtagggtattttgaatatagctgagaaagctgctatgaactgaaggtttacgtcccctacaacattcacaaatcccaaatgtgatggtatttggagatagggcctttgagaagtgattaggtcatgaggatggaaccctcatgaatgggctgcatggaaaaggacccacagagatgccttgtacttttcccatgtgaggacacagcaagaaagcactgtctttatgaacagaagtgggccctcaccagaccccaagtctactggcaccttgatcttgaagttcccagctcccagaactgtgagaaataaatttttgttaatacaccacaaagttgatggtattttattatagcagcctgagtggactaagacataagcaaatgcattgttgataaaacattctgtcaataacgtaaactgtgaaaattccaggaccaatcttgtaacatgagataaataagaatatttattatgcatgttttatacagtaacaccaaaataacgctcaataagttacacagctgttttctagaaacatggcaaaagaaaaaaaacagtaggaataatatgtattactcaaaattgaaaatatggtcatcttttaaacagatttgaattcatgatttctacgtaaacaaaaacatcataaatatctagaaataatcttttttaacaatgcactagatactatctaaaggctcaattttattgcacatatttggtttaggcttatttgatcaatacatgcagaaaaataaattacaaacgtgaatttttaaaaggaatcaggatgtcattttgtactacaaaaattagatgagggttgatacatttcacagcttaatcttcagaaaattttcttcagctattgcataaaatcactgattaaaatcatcacacatggaagctaagaactattaaatacagtaaaatagctctgttggtacatttaaaataagagaacaggcatcaactattctttgaattgataccaactgtcttctttttatttatttttgagacagggtctcactccgtcactctgcaggaatgcagtggtgtgatcatggttcactgcaccttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcacataatcaatattttatcattttatatttggaaaaaaacgggaagctggggtaaaccagtttctaaataaagctaatgaaactttaattcattcaaacactatggtagttatgttgatgataagtaaacattattatttatttatactgtttcctgaggtgatccagaaactactgttattatagtagacttgctactatatacatttactatccctgcaaatgtgctttggaaataataacaaaaattttaaggtagacccatgtgtaatttaacatgctttctctgttacaaaagctatctttaggaaattcttaagtatcaaaaatccaatttattccattttcagaagacaaggaaaaagcactcataaactctaggccataaaaaaataggtttcataagtagctcctttaacatgaagaaaatgacaataaaaatatcttacttgcatgttacttctggaataatgtcaaaaatctatgtagatctttccattttaaatgatgttaaaatagtgtcagcactgtgactgactcatagcaagtatgggtatctatccaaatatttgtctttgaaacaagaaacaagtgaccatccgatgaaaagtgcatgcctcttaacagtatctttctgtaagaaaaattaggtgatctatatttacatttgggcagtggggggatgaaaactgctcttaccaagatggctgacttgaataaagacagtcaatatttttcaaaaaattcactgctctggtactgagatctccatgataacagattacagttaaacagaaaatgctgtgaaataccttttacagaacacagcctgactttgcagattaacttaaagatatatttcttgattatttcactgttaaaaatcaagaaaaacactactaacatttcaacatcttaaaaatagaatttatgcaatgacatttttaagctctgcattttgtatactattaccgtctttaattacagttatgttcatccatatatcaaaaggcagcactggtaaccttgataacattatatatgcttatgtgtttaagacagtcttgattaaatatttccataccttatctgcagccactattcttatcctttcttcccaggaggagaatgaagtgggactaggcatttacctggcacttgcctgcactatcattcattggcactaatgattaggatgcttgaaccatgcagttttgtttctatttcaacaatatgacactgaagtagccattatcttttgatatttaagcctaagtaatagtatattcttcatgccaagttttgacagctcaataatttgtattctagaggggaaaaatgatatttttgctattattt

SEQ ID NO: 379333 - DNA, 2804 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaaggtgagcagtctgggtcggtagcgaaagcggagaccttagctgaccccgcagctgtctttctctttgttaacctcaacacatcgcgcccccttccgggaacacttgctcttctctccttggcttaactagtcccggtttttcattctttatccgtgacctttagggaaccgtgggggggaagtctggtttccgtcctgctgctttccttcaactacaagatggcttctcaaaaggacgcatgcaatgccattcctcaaagacaagggtctcactccgtcactctgcaggaatgcagtggtgtgatcatggttcactgcaccttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcacataatcaatattttatcattttatatttggaaaaaaacgggaagctggggtaaaccagtttctaaataaagctaatgaaactttaattcattcaaacactatggtagttatgttgatgataagtaaacattattatttatttatactgtttcctgaggtgatccagaaactactgttattatagtagacttgctactatatacatttactatccctgcaaatgtgctttggaaataataacaaaaattttaaggtagacccatgtgtaatttaacatgctttctctgttacaaaagctatctttaggaaattcttaagtatcaaaaatccaatttattccattttcagaagacaaggaaaaagcactcataaactctaggccataaaaaaataggtttcataagtagctcctttaacatgaagaaaatgacaataaaaatatcttacttgcatgttacttctggaataatgtcaaaaatctatgtagatctttccattttaaatgatgttaaaatagtgtcagcactgtgactgactcatagcaagtatgggtatctatccaaatatttgtctttgaaacaagaaacaagtgaccatccgatgaaaagtgcatgcctcttaacagtatctttctgtaagaaaaattaggtgatctatatttacatttgggcagtggggggatgaaaactgctcttaccaagatggctgacttgaataaagacagtcaatatttttcaaaaaattcactgctctggtactgagatctccatgataacagattacagttaaacagaaaatgctgtgaaataccttttacagaacacagcctgactttgcagattaacttaaagatatatttcttgattatttcactgttaaaaatcaagaaaaacactactaacatttcaacatcttaaaaatagaatttatgcaatgacatttttaagctctgcattttgtatactattaccgtctttaattacagttatgttcatccatatatcaaaaggcagcactggtaaccttgataacattatatatgcttatgtgtttaagacagtcttgattaaatatttccataccttatctgcagccactattcttatcctttcttcccaggaggagaatgaagtgggactaggcatttacctggcacttgcctgcactatcattcattggcactaatgattaggatgcttgaaccatgcagttttgtttctatttcaacaatatgacactgaagtagccattatcttttgatatttaagcctaagtaatagtatattcttcatgccaagttttgacagctcaataatttgtattctagaggggaaaaatgatatttttgctattattt

SEQ ID NO: 379334 - DNA, 3710 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaaggtgagcagtctgggtcggtagcgaaagcggagaccttagctgaccccgcagctgtctttctctttgttaacctcaacacatcgcgcccccttccgggaacacttgctcttctctccttggcttaactagtcccggtttttcattctttatccgtgacctttagggaaccgtgggggggaagtctggtttccgtcctgctgctttccttcaactacaagatggcttctcaaaaggacgcatgcaatgccattcctcaaagacagtatgttgatttcacagtgtttttatatgaacaacgttcaagtgtcaaaagtatcaatttccaggctaggagctacaagttaaaaggaaaacaaaaatgttccaaagatacagtgtttattagctacatcttgggaagtgcctttccagagagtaacatgaaaacttctgcgtgacaaagtgcacgaagtatctgaattatttcattgggcaattgtcgtgcaaaagaaatagcaaattaccgtagaaacaaaatagtaagagcacagctagatggataaagatacagatgtgaaaatatagatgccctttgcatgaaaattcagttttcctcagcactagagacccagatactcctgaattagcattataataaagtcgtcactagctaaccatctgcctttcctccaatccacggacgtggtcctcaaaataacattttatcttgtgagaaaccttcattaattacacctaacaacaccatgacgcaggttcatgaggatactactgaaggcaaaaggaaatccctatttctctgaccctttccctaatttccacttagcacaaataagactactggacagtctgattttaaaaaatcactgtatgggccgggcttggtggctcccgcctgtaatcccagcactttgggaggccgaggcgggcagatcacttgaggtcaggagttcaagaccagcctggccaacatggtgaaaccccgtctctactaaaaatacaaaaattacctgggcgtggtggcaggcgcctgtaatcctagctactaggggggctgaggcaggagaattgcttgaactcagggtcagaggtcgcagtgagccgagatccctccactgcactccagcctgggcaacagagtgagtctctgtctcaaaagaataaaataaataaaaaccactgtatggagcaaaaactagaaggacatataccacatgttatcagtaatctctaattttgctctgtgattttgtgcattttccaagttttttgcatcaggtctgattttcaagtttaattctctgagaaacattctcatcagaggaatgttctatcttcttagagaaacctgattggcctagtgaaactgtcatgttcctactctctataatcatattgtaattctttgcttgtttccctagtaaaggtgaggcaattttcgggtaagggatttccccctcacctctgccctccaagtggccagcatctgctttgcacacagaaatttttacatctgctatatgtttgcattaatatgttcaacaatgatcctaatgtaggccagtcattttggaaatgcattgtgaagtggagaggattattaaatacctcacattttgttccttgtgccagtttaatgagacaccctcagcaattgctatttaccagaccagaaaatgaattttacagttccaattccagttccctttctctaaccactctgttctaagagttccccgtaacattatgatcttatggacacatcaggtaagtgtatgtatttcaacacagaattttctaagaatgtgtgttgtggtgttaaatttctatgtaagcagctgtcacgtgcatgatctgctgcagtttgatcatcctgcgcctggatcatcaaatgcttagcagccatcattttaccagtcttatctgacaatctgctgttaatgactaacaaccaggggactttataggttaaaatttttattaacttcctctgttttcagtgtttaaagtagaaaatttggccaatgtggctcacgcctgtaatgccaatactttgggaggccaaggagggtggatcacctgaggccaggagtctgagactagcctggccaccatggggaaactgcctacaaaaaaatacaaaaattagctgggtgtggtggcccagctactcaggaggctgatgcatgagaatcacttgaacccgggaggtggaagttgtagtgagccgagatcgtgccactgcattccagcctgtgctacacagcgagactctgtctcaatgaatgaatgaatgaatgaatgaatgaatggagtgaagtagaaaattctaggggaggacatgtcaccttccattattacagaaacaaattatccttaaagcaaaatggaaataagctaagtaagatgatatgtggaaaatatatcgaaataggaactattgctgtttcttgagatttgaacctttatagtgttattaggtgccatatcacatccatcttaaaacctaataaaaatttaaagctgtggtatatatatacaattgaatattattcagccttaaaagggaatgaaattctgatacatgctacaatatggataaaccttgaaaacatgcaagatgaaataaaccagacacaaaaggacatatattgtacaatttcacttatatgaagcgcctagaatgggcaaattcacacagatggagagtagaatagaggttcccaggagttgggagaaggc

SEQ ID NO: 379335 - DNA, 4850 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaagaatgtttgttgcagatacagttccaccactctacattaagtatgtggaaaacagaagatatccttttggttcctgggtctccagaacagtaggagcaaacatccaaatctgatatagcacttccagagagcctggtcttggaggataaaactttaccttgatgggacttttggccccggtcccttaagagttgggatttggggttgtactgcagcacaactcagcctatcctaatacatatgggaatgcaaacatctcagatatttcttcttgggtgcaatttaaaatacgtatgaaatggcttcagaagtgtccatgaaccttcaaaattacatacaagaattagggagatacatttttctgggaacatacagatgttaagacttcccttctccgtctctatattgccagaagagagggccccagaattaaaaccccatccttcctacaacactcagctttctctttcaggaatatcagtactaatatcaccatgccttttatctctaggatatcttcatcccctgtaccttaatttctgcatgacttcatagggagtccatattgcttgatttttctccatatcattaccattgacataaattttccttacattcttagaatgtgtatttcctcacctttttagatttcctggctcttatgttgactgctgtatccctagtacctaccacacaacaggtattcaacaaatacttttttttttttgagacagtctctgtcacccaggctggagtgcagtggtactatcttggctcagtgcaacctctgcctcccgggttcaagcgattctcctgcctcagcctcccaagtagcagggattacaggcctgtgccaccatgcccagctaatttttgtatttttagtagagatgggtttttgtcatgttggccaggctggtctcgaactcctggtctcaggtgatttgcccactttggccacccaaagtgctgggattacaggcatgagccactgtgcctggcctaaaaaatacttactaaatgactaaacaaataaaagatagtctctaactttcatcataatctcaaagagcttcatgatctggaagaagtttagacacaaatgggtaggcaaagtatttcttaattgctggtgcaagaccttacccttgtcttaataattatcctgtctaagtaatacaccttttaagaaacccctgaaaggaagatgatcgtccttggtagatactgaaatctgaggtaaagtggcccataaactgttttgaaatagagaatttctaaaatatgtagggtattttgaatatagctgagaaagctgctatgaactgaaggtttacgtcccctacaacattcacaaatcccaaatgtgatggtatttggagatagggcctttgagaagtgattaggtcatgaggatggaaccctcatgaatgggctgcatggaaaaggacccacagagatgccttgtacttttcccatgtgaggacacagcaagaaagcactgtctttatgaacagaagtgggccctcaccagaccccaagtctactggcaccttgatcttgaagttcccagctcccagaactgtgagaaataaatttttgttaatacaccacaaagttgatggtattttattatagcagcctgagtggactaagacataagcaaatgcattgttgataaaacattctgtcaataacgtaaactgtgaaaattccaggaccaatcttgtaacatgagataaataagaatatttattatgcatgttttatacagtaacaccaaaataacgctcaataagttacacagctgttttctagaaacatggcaaaagaaaaaaaacagtaggaataatatgtattactcaaaattgaaaatatggtcatcttttaaacagatttgaattcatgatttctacgtaaacaaaaacatcataaatatctagaaataatcttttttaacaatgcactagatactatctaaaggctcaattttattgcacatatttggtttaggcttatttgatcaatacatgcagaaaaataaattacaaacgtgaatttttaaaaggaatcaggatgtcattttgtactacaaaaattagatgagggttgatacatttcacagcttaatcttcagaaaattttcttcagctattgcataaaatcactgattaaaatcatcacacatggaagctaagaactattaaatacagtaaaatagctctgttggtacatttaaaataagagaacaggcatcaactattctttgaattgataccaactgtcttctttttatttatttttgagacagggtctcactccgtcactctgcaggaatgcagtggtgtgatcatggttcactgcaccttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcacataatcaatattttatcattttatatttggaaaaaaacgggaagctggggtaaaccagtttctaaataaagctaatgaaactttaattcattcaaacactatggtagttatgttgatgataagtaaacattattatttatttatactgtttcctgaggtgatccagaaactactgttattatagtagacttgctactatatacatttactatccctgcaaatgtgctttggaaataataacaaaaattttaaggtagacccatgtgtaatttaacatgctttctctgttacaaaagctatctttaggaaattcttaagtatcaaaaatccaatttattccattttcagaagacaaggaaaaagcactcataaactctaggccataaaaaaataggtttcataagtagctcctttaacatgaagaaaatgacaataaaaatatcttacttgcatgttacttctggaataatgtcaaaaatctatgtagatctttccattttaaatgatgttaaaatagtgtcagcactgtgactgactcatagcaagtatgggtatctatccaaatatttgtctttgaaacaagaaacaagtgaccatccgatgaaaagtgcatgcctcttaacagtatctttctgtaagaaaaattaggtgatctatatttacatttgggcagtggggggatgaaaactgctcttaccaagatggctgacttgaataaagacagtcaatatttttcaaaaaattcactgctctggtactgagatctccatgataacagattacagttaaacagaaaatgctgtgaaataccttttacagaacacagcctgactttgcagattaacttaaagatatatttcttgattatttcactgttaaaaatcaagaaaaacactactaacatttcaacatcttaaaaatagaatttatgcaatgacatttttaagctctgcattttgtatactattaccgtctttaattacagttatgttcatccatatatcaaaaggcagcactggtaaccttgataacattatatatgcttatgtgtttaagacagtcttgattaaatatttccataccttatctgcagccactattcttatcctttcttcccaggaggagaatgaagtgggactaggcatttacctggcacttgcctgcactatcattcattggcactaatgattaggatgcttgaaccatgcagttttgtttctatttcaacaatatgacactgaagtagccattatcttttgatatttaagcctaagtaatagtatattcttcatgccaagttttgacagctcaataatttgtattctagaggggaaaaatgatatttttgctattattt

SEQ ID NO: 379336 - DNA, 1185 bp, Homo sapiens
cggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtgtaattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaagagggtctcactccgtcactctgcaggaatgcagtggtgtgatcatggttcactgcaccttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcac

SEQ ID NO: 379337 - DNA, 678 bp, Homo sapiens
ctcctccctgaccggtcctcctgccctaagtctcctccctgacccgtcctccagccctaactcctccctgaccggtcctcctgccctaagtctcctccctgaccggtcctcctgccctaagtctcctccctgaccggtcctcctgccctaagtctcctccctgaccagtcctcctgccctaagtctcctccctgaccggtcctcctgccctaagtctcctccctgactggtcctcctgccctaagtctcctccctgactggtcctcctgccctaactcctccctgactggcctccatccaagcagagcttgagtattgctggttccctgctcaaacccaccactggcactggcttcccatcacatacagaataaaggctaaatgtctatgcttggcacagaaagtcatcaacaggccccagagcacgtttctggtgttatcttctgctaatgccctgccctcactcctatgctgcagctgaatggaacgagccattatcccctcaggaacgctggcttctcagtaaacgattatagcccagaagctctgtcatcacagaacctagctattggctaatgggtcagctttggcttcatttctctgaataatttatttcaaaacataatcccaaggaacaaggttaggaatccggccctgctgtggctggttggtgcttca

SEQ ID NO: 379338 - DNA, 709 bp, Homo sapiens
ctcctccctgaccggtcctcctgccctaagtctcctccctgacccgtcctccagccctaactcctccctgaccggtcctcctgccctaagtctcctccctgaccggtcctcctgccctaagtctcctccctgaccggtcctcctgccctaagtctcctccctgaccagtcctcctgccctaagtctcctccctgaccggtcctcctgccctaagtctcctccctgactggtcctcctgccctaagtctcctccctgactggtcctcctgccctaactcctccctgactggcctccatccaagcagagcttgagtattgctggttccctgctcaaacccaccactggttgctggttccctgctcaaacccaccactggcactggcttcccatcacatacagaataaaggctaaatgtctatgcttggcacagaaagtcatcaacaggccccagagcacgtttctggtgttatcttctgctaatgccctgccctcactcctatgctgcagctgaatggaacgagccattatcccctcaggaacgctggcttctcagtaaacgattatagcccagaagctctgtcatcacagaacctagctattggctaatgggtcagctttggcttcatttctctgaataatttatttcaaaacataatcccaaggaacaaggttaggaatccggccctgctgtggctggttggtgcttca

SEQ ID NO: 379339 - DNA, 463 bp, Homo sapiens
gccacactgttgactatacacttagtatttatatgtgtattttatttctctaaaaaaagtcaggaccagtttatagcattgcagctatctgttctttgaagatttggcagaatttttctatgaaaccacctgggattggtacttttttgtggtgtagttcctggataagtttttctttttttcttctagggaaatcagtcttttttaaaccttttatctaacagggtcaattttggtaaacccttttttcttataaaattatcaatttcatctaacttttcaatttatttgcacagaggtctggaaagtaagatctgggcacagagccatgtgcctgtagtcccagctactcagaaggctgaggcaggaggataactggggcccaggagtgcagggctgcagtgagctgtgattgtaccactgcactccagcctgagcaacagagcaagaccatgtctcttaa

SEQ ID NO: 379340 - DNA, 2258 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataaaatacgaaatgtgacaga

SEQ ID NO: 379341 - DNA, 2153 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataaaatacgaaatgtgacaga

SEQ ID NO: 379342 - DNA, 539 bp, Homo sapiens
tttgcctgccctgcctttttttccagattattccattctttattctgtgtcccagagctgctgatcttattattaattttacctttttcctttctttgtttctggttaatcattctaggatgcaaaatacagactccgtgtatcagtggtgcgatcaaaatcttcctcttcaagcacatcattagaacccaggccattaagctcattgaaactgagtttcttttcctataaaataaaaataacgtagccttcactccattcaggctctctcaatctgtgatctatgaatctcagagaaatgcagtttcagtttttccttttcatttccgcaaactaagtacacagtgtactgcatcttctagggagacgttctcaaagatcctgaacgtagccattgacacgcaaagcagaatttaattcgttaattatttcaatgttttattaatgatagtgttcaccacactgtaaacagatttatccttccagctttaattaaagctcttgggagtgctttcctcaaaataactgtgacttttctc

SEQ ID NO: 379343 - DNA, 3013 bp, Homo sapiens
  misc_feature (1932)..(1932): n is a, c, g, or t
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttgtaagttaggctgccaccgtggcaaccaatttggtcttttaaatggatgatcaatttttacttgtttgtttggtagctttctgtctggcctggtttatttttgaattgatttgaaatgaaaagtgcaattagaggtttaaatctaaccaaggggtctcatgttcccagatccagaagccgggaggaaattatgtgaatgtttccaaaaaaagtcaatacaggccaaattaagtgtcagactcaagaattgctgtaagccccccatggggacacagattctgcgtgggataaacactgtcctcttagaaccttaggaatttggggttttgttgtttttcccccctcgatttcttcatcctttcatagattctttctgtctgtaatcagctagttttagaaaacatcttttcatctatctactgtggctcacaaactaatttacaagtgcatttgactgcttcttgtaagaacgcgtggaaccaaaggtatntcattgtgttccctcagatcacacaaataacacactacctccgtactgctttcaaccaaggaggcagcacagaccataccgtgtccctcggcgctctgccctagctcatttggaacagagatgtttttctcagcctgcctgtttatttgaagttacacttgctctgattttctaatcaaaagatttcggagaattcatactcaccatctcccagaaattaaaagcttgccctggaggctgagcaaaacacaggaaattgatgaggataggagcaaagatccaggtagcttgcaatgatgggcttgggaagaggccaattaacctgtctctcttttgagcattcacgtacttgattttctccttgtggatctggaactgagaaaagccccctgggtgtgaagtgagaaaatctattaattccctttgattagcagtgaaacccccactctcggacagggcaggcaagatggaagcagctacagatagacagctgttctgtaggaggaaaatgctatgggcaggcaagttcaaggccattgtctagtcctggaggacatggaaccagtttgtctggggtacaagaaccttcctagtcaacgctcatggagatgaagtgagtaaattttgaccccaagtttcatgactgattcttgtttgggaataaatttctgaagacatactttaggttcaaggaaataaaaaatcactaactctaatgaggcacctaccagccaaagaacccagagagagccgggagagctgaccttagactgtcaggccatttctttttaaaataagcgctacttcaggaggagaaaaccaaacaacacatgttcttacttataactgggagctgaatgatgagaacacatggatgcattgcagggaacaacacacactgggacttgtcggtagcggggtatgtgggaggacggagagcatcaggaaaaatagctaatggatgctgggcttaataccaaggtgatgggatgatctgtgcagtaaaccaccttggcacacagttacctgtgtaacaaacctatacatcctgcacaggtaccctgaaacttaaaggttgaag

SEQ ID NO: 379344 - DNA, 3212 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcc

SEQ ID NO: 379345 - DNA, 2278 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataaaatacgaaatgtgacagaaaacatgtacctctcttctc

SEQ ID NO: 379346 - DNA, 2549 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagccaggctggaagtttccacattgaacctctcactccataaccctccccaacaaaaggccctggttaaatgtacaggatggggaaggacattggaaggtaaaggcagactgtcattctctgaagcgagaagtgcctgaaacattttttcaggcaaagcggttccatgtcctggtcatttcaaaaatatccaagttcctacattttatggtatcatcagaatatgaagagccaaaagaatggatgatgtcattttctgttctataaacaataaatgtaatgtattaacaaagtaaatacaggcagaactgtgtgtgctgggg

SEQ ID NO: 379347 - DNA, 2381 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggctccagattcttcaagcatcatcacaagcagcagtcaatgagacctcaaaaccttcatcataattccattttgctattatagactcaactcagagtcttactatttcatcttgctgattctcatcaatataataaactccatgggcatata

SEQ ID NO: 379348 - DNA, 2238 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacagggtggcaccactgtgctggccacagaaaagcccacggtcatagacagcaccatacaatcaggtatcaaataaaatacgaaatgtgacaga

SEQ ID NO: 379349 - DNA, 1705 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtatgcagcataagatcaagcctatctaggattgaataagtttttgaccatctagagaggttgttgaaagaaagtggtactgtgccaaatggcctccaatgagaagataggttcacggccgtcaggtataaatcactgcaagagaagataggttcacggccatcaggtataaatcactgcaaaatgagcccatcgctacacgatcagagaaaagcaggcccaagatgacatccctgaaaacgcatttatcttctcagatacttattatactactcttccgagaatgtgactacaagtgtctcactttgataacagctccaagatctgatttttcccaactacacactgtctgttaatgggcttcctattttgacatgtttttatttcctggatgaaatatatgaatcctgtttatagac

SEQ ID NO: 379350 - DNA, 2526 bp, Homo sapiens
  misc_feature (1445)..(1445): n is a, c, g, or t
gcggccgcctactactactaaattcgcggccgcgtcgacgaggattcctaccgagagtggatacaggtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttgtaagttaggctgccaccgtggcaaccaatttggtcttttaaatggatgatcaatttttacttgtttgtttggtagctttctgtctggcctggtttatttttgaattgatttgaaatgaaaagtgcaattagaggtttaaatctaaccaaggggtctcatgttcccagatccagaagccgggaggaaattatgtgaatgtttccaaaaaaagtcaatacaggccaaattaagtgtcagactcaagaattgctgtaagccccccatggggacacagattctgcgtgggataaacactgtcctcttagaaccttaggaatttggggttttgttgtttttcccccctcgatttcttcatcctttcatagattctttctgtctgtaatcagctagttttagaaaacatcttttcatctatctactgtggctcacaaactaatttacaagtgcatttgactgcttcttgtaagaacgcgtggaaccaaaggtatntcattgtgttccctcagatcacacaaataacacactacctccgtactgctttcaaccaaggaggcagcacagaccataccgtgtccctcggcgctctgccctagctcatttggaacagagatgtttttctcagcctgcctgtttatttgaagttacacttgctctgattttctaatcaaaagatttcggagaattcatactcaccatctcccagaaattaaaagcttgccctggaggctgagcaaaacacaggaaattgatgaggataggagcaaagatccaggtagcttgcaatgatgggcttgggaagaggccaattaacctgtctctcttttgagcattcacgtacttgattttctccttgtggatctggaactgagaaaagccccctgggtgtgaagtgagaaaatctattaattccctttgattagcagtgaaacccccactctcggacagggcaggcaagatggaagcagctacagatagacagctgttctgtaggaggaaaatgctatgggcaggcaagttcaaggccattgtctagtcctggaggacatggaaccagtttgtctggggtacaagaaccttcctagtcaacgctcatggagatgaagtgagtaaattttgaccccaagtttcatgactgattcttgtttgggaataaatttctgaagacatactttaggttcaaggaaataaaaaatcactaactctaatgaggcacctaccagccaaagaacccagagagagccgggagagctgaccttagactgtcaggccatttctttttaaaataagcgctacttcaggaggagaaaaccaaacaacacatgttcttacttataactgggagctgaatgatgagaacacatggatgcattgcagggaacaacacacactgggacttgtcggtagcggggtatgtgggaggacggagagcatcaggaaaaatagctaatggatgctgggcttaataccaaggtgatgggatgatctgtgcagtaaaccaccttggcacacagttacctgtgtaacaaacctatacatcctgcacaggtaccctgaaacttaaaggttgaag

SEQ ID NO: 379351 - DNA, 1567 bp, Homo sapiens
ttgcttgttggtgtgagtttttcttctggagactttgtactgaatgtcaataaactctgtgactttgttaggaagtaaaactgggatctatttagccactggtaagcttctgaggcgatcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcc

SEQ ID NO: 379352 - DNA, 331 bp, Homo sapiens
taatgatgaacagtgggaaatgggtgagtaaagaggtggaagagagggtaaagctaagtcttaatagataaggttacagcctgtcccctgaccagtgagatgcagtaggcctgcactaattggaagttcacagcactcagggtgttatttgttcagtcttccaattccttgggactatgaaatatttctcctgttccccttttcctgctgcttcctgcagcttctccaaaccacatacagggcagggtatttgtccttgagaaaagtaaacagctccagtagccaaacagaggaggaaccatagcatcttactttaaaccctcagttttct

SEQ ID NO: 379353 - DNA, 387 bp, Homo sapiens
aagtttccacattgaacctctcactccataaccctccccaacaaaaggcattgatctaaaaacatatcctttaaataaccaaattgccacaagttacatgatcaagacaagaagataaaagagcagtaaaatacaaaaacttagagcggttcacctggttaaatgtacaggatggggaaggacattggaaggtaaaggcagactgtcattctctgaagcgagaagtgcctgaaacattttttcaggcaaagcggttccatgtcctggtcatttcaaaaatatccaagttcctacattttatggtatcatcagaatatgaagagccaaaagaatggatgatgtcattttctgttctataaacaataaatgtaatgtattaacaaagta

SEQ ID NO: 379354 - DNA, 3368 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcc

SEQ ID NO: 379355 - DNA, 4035 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtgcagaaaccatcttcatcccattgctgtaccatttcagttcatgtcttagttgggaccagctaacgcctgtgtgtgtgcttgtaactccgcatggcagagagctgcccaggaatagaagctgccttgccagaacacgtgcatcttcatttcctcatgtcatctggatagatgagttgttcttaatagccacaaccatttgtaacaataatttgagccatttcgagagccaaaggctaggattatcttaattgaataagaatttccccatggctaaatgtactaaaccgatccttattttcattattttcagacccccccccaataacacgtgcaccacccctacgtaaccacacacttcagaatgtttattttcattttctaatgaggacaagtttttttgagtggatcctttatccaacaaatggataaagttaggcttatatttgaagtgcggcttttaagttgggatttggtaaatcattgtacattaacatttacaaaggcagaattagctgctatttcacatcaccaccgaccagcaaatgcatcagagatgttgtgtgccaaatgtctcactaattaatctagagtattactctctaatctcctaaaaccctaaaagctaggaaatgaccttctcttccacttggaatggcagaggaaatattaggcaagtggagaaatgggattataccatttggaaattggccaaggcactagggttttcaccctgtggttgcaaaaggtatcgtgggacttttactgctccctgggtcaaaacgcagtttcaatagcatctgactctcatttgagattaaacatgagcttttgaatgcaggtctgcatttttacccagaagggactcggagagcccacataattaatttccatgggcaaaactgaaggcgttaccatgtaacttcataataaagccatgttattggctaatgcattcgtacaaaatctggaaggaagtgtcctagagtacatttccaattatttcaaaagctctcctctgaaggagtgagagggctctgcactctaagatggaataaagagtaaaagaaagaaaaaaaaattgaaaatctgtcccagaaatttagtactgtgaactgagtttacatttaaatcccacctcctaaagctgtctctctccaaatttccaggataatcatttacattcatatggccaataaatgtcacattgctatgagcttttgaatgcaaatcttgtatacaagcagccacaagccacaaaacttagattaattaatgcagagacattttctgtgtaacatgtcaagttcaagttgaaaactcaaccactgatataaaaaacagagtactattccatgaaccaagtcctctggaagcttcccggggttgcctgtaaacactctgccacaaacctcaggctttttacagaccccgtcacacatccatagtgaaatttctcataaaaaaggaatgattgcaggatcccagtgtgccctttcaattgccctcttgtggaaggggttcttttcttcataaaccctaaagtggtcagttaatattgattagaaacaaagcctcagatttactcctcatatcagaacaaccagccttctcatttttgcattagttcatgactgaatcaattgaaactgaaggctttgaatgaaatagggcgagtatgttagcctggagcaaattgtgtatggcagcgagttacaaaccacagaaaatgggtcatttatagtggaaacactgacaacctttcaaaactataaggttttgctttacctacagtgtttcaattatttctttggtagatagaagaaagttcattctgattttttctttttacatattagcatggtg

SEQ ID NO: 379356 - DNA, 1321 bp, Homo sapiens
ctggagaggacaggtggatgggagactgcaatttcaacaagcattctggtgattcttatggttgggcaagtttaagaacactactttaaaacagaagtataatgatgaacagtgggaaatgggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcc

SEQ ID NO: 379357 - DNA, 2329 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataaaatacgaaatgtgacagaaaacaaaaaaaaaaaaaaacacaaacacacgacacacacaaacaaataaaaataataaaatataaaaacaaaaaatataaataaaaaaaacaaataataaaaataaatataaagaaaaaataaacaagaaggaaaggagagcgaggagtaaaaacaacaacacacacaacaacaag

SEQ ID NO: 379358 - DNA, 2008 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtggcaccactgtgctggccacagaaaagcccacggtcatagacagcaccatacaatcaggtatcaaataaaatacgaaatgtgacaga

SEQ ID NO: 379359 - DNA, 2206 bp, Homo sapiens
  misc_feature (2204)..(2204): n is a, c, g, or t
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacagggcactcttttttgttggccacagaaaagccgaggtttatagaaagtataatttantt

SEQ ID NO: 379360 - DNA, 1998 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtgagggctggggactgggaggaggtcatcccttatgtccttgacttcaatcaagggcctctggcattctcccgaggaa

SEQ ID NO: 379361 - DNA, 1707 bp, Homo sapiens
ttttttttttgttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggatgcaaaatacagactccgtgtatcagtggtgcgatcaaaatcttcctcttcaagcacatcattagaacccaggccattaagctcattgaaactgagtttcttttcctataaaataaaaataacgtagccttcactccattcaggctctctcaatctgtgatctatgaatctcagagaaatgcagtttcagtttttccttttcatttccgcaaactaagtacacagtgtactgcatcttctagggagacgttctcaaagatcctgaacgtagccattgacacgcaaagcagaatttaattcgttaattatttcaatgttttattaatgatagtgttcaccacactgtaaacagatttatccttccagctttaattaaagctcttgggagtgctttcctcaaaataactgtgacttttctc

SEQ ID NO: 379362 - DNA, 1655 bp, Homo sapiens
gtttcatttcacttcccagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcc

SEQ ID NO: 379363 - DNA, 359 bp, Homo sapiens
aggtgggctttccccaacgctgccctcttgacccttggagctctcccaggattcctcagatttccccagcgcccctttggcactgtgtctcctcctctttgccctgccttctccctgtcccaccaccacctcctcaccctgtctatccctcctcctctttgctctggctccttgccaccaggatcttttcctaacttttttctttcctagtagagacaatgggctgacaacctgacttccaaaaaatattgaggaaaggcaaaaactagtttttaggccaggtgtggtgactcaagcctgtaattccagggctttgggaggctgaggttggaggattgcttgaggccaggtgtaggaca

SEQ ID NO: 379364 - DNA, 1613 bp, Homo sapiens
tttacagggcataactcattttatccttaccacaatcctatgaagtaggaacttttataaaacgcattttatatacaagggcacagagaggttaattaacttgccctctggtcacacagctaggaagtgggcagagtacagatttacactaggcatccgtctcctggccccacatacccagctgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccggcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctaca

SEQ ID NO: 379365 - DNA, 1492 bp, Homo sapiens
tttacagggcataactcattttatccttaccacaatcctatgaagtaggaacttttataaaacgcattttatatacaagggcacagagaggttaattaacttgccctctggtcacacagctaggaagtgggcagagtacagatttacactaggcatccgtctcctggccccacatacccagctgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccggcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctaca

SEQ ID NO: 379366 - DNA, 1650 bp, Homo sapiens
tttacagggcataactcattttatccttaccacaatcctatgaagtaggaacttttataaaacgcattttatatacaagggcacagagaggttaattaacttgccctctggtcacacagctaggaagtgggcagagtacagatttacactaggcatccgtctcctggccccacatacccagctgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccggcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaaaacaaaaaaaagggggggccgcccttttattttgttcttttaaaaaaatttcgtttgtaatattagctcaaaactcccaactcaccttgtatttaaacagggatggtgacacctcccagcccttaggagaaaaaatgtgatcccggtttactagaaaaaacttcccggacccttacaaaacccaaa

SEQ ID NO: 379367 - DNA, 468 bp, Homo sapiens
catcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgt

SEQ ID NO: 379368 - DNA, 3908 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttca

SEQ ID NO: 379369 - DNA, 1070 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttggaacaagttgccgattcgttggggaaaaggcctgtggccttccggggccttttgacagaaaaaagttcccacagctcctttttccggcgacagttggagatccactctatgatatggagg

SEQ ID NO: 379370 - DNA, 1171 bp, Homo sapiens
aaggagttttgactttgcagggcccctgagaggctctgggagatcctcaggggtacgtggatcttactttgagaaccagtgctctgaatttattctgagcatcataatatgtatatataattatgtatatttaaaatgttttaaaaacaaatatgaatacactgttgcataacagttatgattagcagaattgtgtagctgttgtgattagcagtgtacaaaaaggatctgtttgcgaccagccttgccaacctggtgaaaacctgtctctattagaaatacaaaaattagctgggtgtagtggtgggcacctgtaatcccagctactcaggaggctgaagcaggagaattgcctgaacctgggagacagaggttggagtgagccgagatcgtgctattgcactcccacctgggtgacaagagcgagactccccttccaaaaaaaaaaaaagatctgactctgggtatgaaatttgacactaccctggattcataactctcctgtcagtaggacgccatagtaaaatttccctggggactgtatcaggttacagagagctgttggactcccccgccatgtgccgcacatgtgaatgctgtaaaggcagaatgctggttgcagatcacaatatcaggtacactttccagtagcccctacatggctgagggagagagtgcttcagggaaatacttcgtaggtgactgtagagactctggaaggagaaagcatcatggatagatctgaaagctaaggtcttctcagaagctagagttactgaagagtgagtttctacctgggagaagacggcctctcccttcgagtgccttccactttgtgtcctggtggcagcaactttttgttttctgccttagagctcatggtgacacccagcactgccggaaggctctgcaccgggccgtccagtgcaccagtgactacccagagcacgtctgcgaagtgttactcaccatggagaggacagaaggtgggacccccagctctcttctggcttggagcctaacccatttgctgtttggtctcaagtaggagcatctggttacagtctggggacagactgtgtttatgctgccaccttaggtggtgccctatgattagactgtcacaagtgtcctgaaaatgagtcctcctgcagctcttctcaaattctgc

SEQ ID NO: 379371 - DNA, 405 bp, Homo sapiens
aaacgtgactatctagtactgtcgagtaagtaccgtgcgctccctctctcggttctcaggaaacataggtagattagcttgtggctgcagaaaggctcaagtgtttgggctgggtcgtttaccactggagggaggcctggggaatgcccagggacatctgtaacactaatagttgtggggtgctttttatgtgtgtctgttggaagtgtgttgtatgatgggtgtcgacgtcataaggttcaggtctcctaacagcctgctgatgcactttaggctcgactgtgcaataacatgcagaaagctcgggaactctgggatagcatcatgaccagaggaaatgccaagtacgccaacatgtggctagagtattacaacctggaaaggtaactgatctcggggtgggga

SEQ ID NO: 379372 - DNA, 380 bp, Homo sapiens
tgtaatgttttttagtcctttatggtcatctctgctgttaggccttcactgtcatttagtgctgctgtctgagtacttttttggtaggcacatttcgtttgttatgcatcagttttgatatttgggtattttatatcccaaactaattgaacacttcttatttttaggtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcgggtgagtacctgtggttgtctctgaacgg

SEQ ID NO: 379373 - DNA, 430 bp, Homo sapiens
tgagacctagttggaaaggcagagatagggtctctgaaaggaatagtgaatgacacctgtattttttggggaaacttcattgaacaagagttccattataatcattttctcttcacaagtaacctcttccataacagcaggaattttacatgagtttagatcattcctctatgggagggatttggttcagaagtgcagttgattggaagtactcataagtgagtttcttggggtttggtaaagagtttccttatttggtaaatacattttggcaatctaagcctttgagtctttggagctatgagtgtgtgcgtgctgggaggatttttctgagtatgggaagagtttgtcatggctgttgtgtttgttccctagacacgggcatgtgttgtacatactcagaacctctgggcaactttactggagccca

SEQ ID NO: 379374 - DNA, 4390 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379375 - DNA, 4472 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactggttaagaaatagaacattgccagtaccttagaagtctcctatgtgcccctctccgattgcctcctcctccctctcccgagagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379376 - DNA, 4859 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctggtgcggatgtttttgtgggagaacttctaagctatttgtcccaagtgaaaaacagagagcggtgacaaagtcattacatcagtgttccctggggttttctttgggttatggagtgtagtgacaaaaagggctctgagtgagagatgaactggttatatttgtggcttcttagagctttttaacatgctaatattcattgtattttctaagaagttgtagtgttttctccaaacttccttgatctggaacttttcttgcagggcgtcttgtggaagaagttttttctagaacacagtctgtagagtgctgtagcaacttctgtcttcaacattcctgtctagctcatttcattctgttgcatctattagtctttaaagtcatgtagtgttttatagtcagtagaatgtagtgactttctattagtttccatttgaattggtaacaaatcctgacttttctccaactccagtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379377 - DNA, 3296 bp, Homo sapiens
aaaacttaggctaggtacgaggctgggttgtgaaaatataaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379378 - DNA, 2621 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactggttaagaaatagaacattgccagtaccttagaagtctcctatgtgcccctctccgattgcctcctcctccctctcccgagagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagcttccaaaacgcagaagggtcgagaaccggcatcccctgaggtgggggaaccccacaagtgtggaagttgccgccgggcccgcgggggaaatggtgcgcgcgggatagtgtggggcccccgtgtaaagcgaaagggaaaggcgctcccctggagagaggactggtccggcgtgtgctaagcagacacaaggaggaccacccgctggggaaacagcctataaattaacgaacggcacacaaaggaccctggcgcgggaagcgagcacacacacagccgagggggatattactagcatgatgtactatacaaccccacgcaatcgaacagacaggcagcatgcgtgtgaacacgagggacaccaaagtagagcc

SEQ ID NO: 379379 - DNA, 2970 bp, Homo sapiens
aaacgtgactatctagtactgtcgagtaagtaccgtgcgctccctctctcggttctcaggaaacataggtagattagcttgtggctgcagaaaggctcaagtgtttgggctgggtcgtttaccactggagggaggcctggggaatgcccagggacatctgtaacactaatagttgtggggtgctttttatgtgtgtctgttggaagtgtgttgtatgatgggtgtcgacgtcataaggttcaggtctcctaacagcctgctgatgcactttaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379380 - DNA, 3086 bp, Homo sapiens
actgtgcgttatacaatgtttaggggcatccctggcttctagccctgaaatgccagtagcagcttcaccaccacaaccaaacatgacaaccagaaatgtctcttaacattgccaaatgtctcttgatgggcaggatccctcctttgagagtcactgtgctctagtacaacatctatccaacaaaggagcttggagaggcaaatggctcaatgtgtcctttgcatcccttgttaaatttcagagccttcagtgttagctagaaccaatagaaaaataatgtgaacttatctgtgggtattggtctggattttgggtatggacccctcagaactggcttgcaaagaccaccaaaaaataagaaataaatgcctcaacatttgagtagctcttaaaattcttcagtcttaatataaatgtacttttgcattagaacgttcgttttcatattctttgccatttagagcccttaatagatcatattctggttttcaagtctctcctgaaaggagagggacattttaaacccacttagaaggactatttgaattctgaacttcaagcctacagggattacattttcttattgtttgatgggagagatctcttctggaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379381 - DNA, 1613 bp, Homo sapiens
  misc_feature (14)..(15): n is a, c, g, or t
  misc_feature (30)..(30): n is a, c, g, or t
atactatacaatcnngctcgtacctcatangttcgcatgctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379382 - DNA, 2646 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctggtgcggatgtttttgtgggagaacttctaagctatttgtcccaagtgaaaaacagagagcggtgacaaagtcattacatcagtgttccctggggttttctttgggttatggagtgtagtgacaaaaagggctctgagtgagagatgaactggttatatttgtggcttcttagagctttttaacatgctaatattcattgtattttctaagaagttgtagtgttttctccaaacttccttgatctggaacttttcttgcagggcgtcttgtggaagaagttttttctagaacacagtctgtagagtgctgtagcaacttctgtcttcaacattcctgtctagctcatttcattctgttgcatctattagtctttaaagtcatgtagtgttttatagtcagtagaatgtagtgactttctattagtttccatttgaattggtaacaaatcctgacttttctccaactccagtaaccttcgagaaagctttgaatgccggcttcatccaggccactgattatgtggagatttggcaggcataccttgattacctgaggagaagggttgatttcaaacaaggtatttaagcacatgtttttcactttagagctgaacatgttcttaatacaacttttggcgagatgtcccagttccccagatacattgtgattgggcaaatgatgtagactaggtattggtgactttttcccccagaaatcttagcaatttctgtctttaacaagtcatgatgtggattgtaaagcaagagagtaatcgtttatactggctcctgccagcctttttagtcttagctctcatttctcctttcaggtctttttatttatcctaaatacttcttgaaataagtctgctgtgttttagaaaaatctttgtacctctgtgggatcctttgccccttcatgtccccccgaaaacaaccagaaaacccctaacttgtacttgcacactcatgtcagctgtcacctcatacaggtagcctttagccattctcttgtttgcctgtgtcaccccagctgggggagactcccccccacagcaccctgtgtttgcctttttcaccacgctgtccatgctctattctgttcaaatttctttctccccaactatgtgatgagggcaggaattggcaattttatttctgtgtcccttgcatgatgccaggtacatagtgggtctcca

SEQ ID NO: 379383 - DNA, 1328 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcccgtagctggcttcctttccccttttgaccgggaacaaacctttgattcacagcttgagaaagtccacagtcttttccggcgacagttggcgatcccactctatgatatggaggccacatttgcagagtatgaagaatggtcagaagacccaataccagagtcagtaattcagaactataacaaagcactacagcagcaccaccattcgtggtgctgctctgttggtgatcacacccattcttcctaggttagcacctccagtcaccatacacaggttaccagtgtcgaacttgatgaaatcagtaatcttgccgtctccaatccatctgaatgagcagcacccacgactt

SEQ ID NO: 379384 - DNA, 714 bp, Homo sapiens
gtcttaatataaatgtacttttgcattagaacgttcgttttcatattctttgccatttagagcccttaatagatcatattctggttttcaagtctctcctgaaaggagagggacattttaaacccacttagaaggactatttgaattctgaacttcaagcctacagggattacattttcttattgtttgatgggagagatctcttctggaggtacagagaaattaagaaaaatttatgtgattgtatccttcaaaatcctaaagagtgaaagttttgcttctctttctttcaaggttctttagaagattgggatatagctgttcagaaaactgaaacccgattagctcgtgtcaatgagcagagaatgaaggtaatgacaatgtttgaagtctttggcacctctggtagctattttggctcagtttggtatggatgtttcttgtcaagatgttttacattttcctaagtgtcttttactcagtattaattataaaatatttagatcaatgcttaaacctgtcttgtgtcatttttacattgttctaaaacatcagccccaatattaagtacttgtttcatttagtgagggaattttggctctaaaatttacgagaattgatgaaaaagaataaagaagagcctcacttagcctagtgagtggaacatgaacaccccaacttatttagggcttcagttttatggatttttttttt

SEQ ID NO: 379385 - DNA, 600 bp, Homo sapiens
tgtggtcctagctactcaggactctgaggtgggaggattgcatgagcctggagtgtgaggctgtagtgagttgtgatcacaccaccacactccagccagggtgacagcaagaacccttctcaaaagaaaaagaaagaaccacagtttgtcatttactactaatttgcttctttagcccgtagctggcttcctttccccttttgaccgggaacaaacctttgattcacagcttgagaaagtccacagtcttttccggcgacagttggcgatcccactctatggtaagagaaactgacatgtcaacagccagccctctatggtttttaaaatgctttggggaacaacatgtagttagacctttcccaccatcctgtgaggcaggtaaagctggtgttcttactctccttggatattgtctctttggatgaggtccttggtaaaaacatcttgaatgttagtgcttaagagggttgtgagggtcagaggcaggactggaagccagactccctgactcccaggtgagagctcttttctcctttgagacctagttggaaaggcagagatagggtctctgaaaggaatagtgaatgacacctgtat

SEQ ID NO: 379386 - DNA, 1183 bp, Homo sapiens
  misc_feature (833)..(833): n is a, c, g, or t
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgtttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtntcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttctggttctggaggttaaggcctcagttctagctgttcaactcttgtatgtgcttgtaagaatttcttaatttctctcaccctctcgacttccttatctgcagattgggagcaacaatttctgcataatataattgttgtaacagt

SEQ ID NO: 379387 - DNA, 4108 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctccagtgtcaaactgctataaaatgaagacacatcacagctggaataatgtcggac

SEQ ID NO: 379388 - DNA, 4444 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcccgtagctggcttcctttccccttttgaccgggaacaaacctttgattcacagcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379389 - DNA, 3705 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactggttaagaaatagaacattgccagtaccttagaagtctcctatgtgcccctctccgattgcctcctcctccctctcccgagagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgtaagtgcttgcatggtagactagtgcaaacttcgtcctggctggcaccagttcatggatcacggggggattaacccgggatgaattagcttcctgttaggacagaaaagccaagatgtgctgttccttgtggtaatcactgtggttccactggagcaaggcgtccagagcaggatgcaagcctaggcagtgacctctgcctggtactggccaatttacacttgtcatttatttcagacagaaataaggcagtgattattttaaagtcccctttgccagttggatctgtgtgtttacaaagaaatctcatacccatgtgtgtgccagtctacggccctagctatgatccacataagctgtgctgttcgctggtttgggatgaggaggagatagcagaattgccaggtgactggtgaggtctgagaggtgatagtcacactgatcccctctgagtgtgactggtgctcagggttgatctttgccaaaactgaacaaggccaagtctgttgaagcagtttttacttcataaacagaattaaggaggcagggattatcttatcctttttttttttcaccttttaacttctggttatattaaaactgtcttggcttattttcacaaataaatgaggggccacgaattgttgcttcaaaaggtccat

SEQ ID NO: 379390 - DNA, 3460 bp, Homo sapiens
aaggagttttgactttgcagggcccctgagaggctctgggagatcctcaggggtacgtggatcttactttgagaaccagtgctctgaatttattctgagcatcataatatgtatatataattatgtatatttaaaatgttttaaaaacaaatatgaatacactgttgcataacagttatgattagcagaattgtgtagctgttgtgattagcagtgtacaaaaaggatctgtttgcgaccagccttgccaacctggtgaaaacctgtctctattagaaatacaaaaattagctgggtgtagtggtgggcacctgtaatcccagctactcaggaggctgaagcaggagaattgcctgaacctgggagacagaggttggagtgagccgagatcgtgctattgcactcccacctgggtgacaagagcgagactccccttccaaaaaaaaaaaaagatctgactctgggtatgaaatttgacactaccctggattcataactctcctgtcagtaggacgccatagtaaaatttccctggggactgtatcaggttacagagagctgttggactcccccgccatgtgccgcacatgtgaatgctgtaaaggcagaatgctggttgcagatcacaatatcaggtacactttccagtagcccctacatggctgagggagagagtgcttcagggaaatacttcgtaggtgactgtagagactctggaaggagaaagcatcatggatagatctgaaagctaaggtcttctcagaagctagagttactgaagagtgagtttctacctgggagaagacggcctctcccttcgagtgccttccactttgtgtcctggtggcagcaactttttgttttctgccttagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggacgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379391 - DNA, 2138 bp, Homo sapiens
agtaacctcggaaatccccacggttgctgaagatgggtcggatctggaccacctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccagagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagcccttgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaat

SEQ ID NO: 379392 - DNA, 2177 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaaggtatttaagcacatgtttttcactttagagctgaacatgttcttaatacaacttttggcgagatgtcccagttccccagatacattgtgattgggcaaatgatgtagactaggtattggtgactttttcccccagaaatcttagcaatttctgtctttaacaagtcatgatgtggattgtaaagcaagagagtaatcgtttatactggctcctgccagcctttttagtcttagctctcatttctcctttcaggtctttttatttatcctaaatacttcttgaaataagtctgctgtgttttagaaaaatctttgtacctctgtgggatcctttgccccttcatgtccccccgaaaacaaccagaaaacccctaacttgtacttgcacactcatgtcagctgtcacctcatacaggtagcctttagccattctcttgtttgcctgtgtcaccccagctgggggagactcccccccacagcaccctgtgtttgcctttttcaccacgctgtccatgctctattctgttcaaatttctttctccccaactatgtgatgagggcaggaattggcaattttatttctgtgtcccttgcatgatgccaggtacatagtgggtctcca

SEQ ID NO: 379393 - DNA, 1170 bp, Homo sapiens
cttctgtccgaagttgtgtcggaacgcatgccattataatgagtttttatatctggtgggagcttttacaagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggagaaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtaagttcccgtggactttttttggatatctggcaatgtcatatatatcagtctgctgttgaggactgtattatgagatgttgctacccagaaaagggaacgttagtttcacaattagcaagatttaagttgagttgtcttatcattgtctttggtctttaattgaggaagtttaattttaaaataaaagtggaagaagcacttgtagtaagggaatgaatacactcacactcaggatttattgacagtgagaacttacatggtatttccactgatcttttatacattcaataggtttttagaggttttggacaggatgctttaaaaaaaaagattaaaacattaaaagaaaacctttttattttgaagtaattataga

SEQ ID NO: 379394 - DNA, 963 bp, Homo sapiens
gggcagagggaagcataataatttccaccaacccttacgtgaagattttttttccttttaaattaccacccaatttggcatttatttaaggtcagggctgtgcttcccataactttgcagagtgtgtaacccgttgacgatttcagcgcaagagacattatttgatttcttgtggaaggcttacaaagtaaagtatcaataccaaacaagtgcttgttgagttctaaagttaaaaaattaaaatcgttctttccttaggtatacaattttattgccaagcaataaaattggcaagaaaaccaaagttattgttcagtactttgtattgttctactctgtgcccaccaaatgtcaaagcactggaaggacagagggacaagagggatggccctttcaggacgggaacccacgtctggctggagagataagaccgattataatcagcaagacatggccaggagctaaattataaggaagaaactgctactgagggggatcaggaaaggatgcagaaggatgtgctggaaaaacagaggagggtttctcagaaaaagcatcttccgtccaaagaaacagtgtttgtacaggatgaaaagtctgaggaggtcatcttgggcaaaggaaacggcagctataaatatttgtgaattaacagatatgcttccctgcacaatgaattaccctttttgtctccagtaagcacccagatcttaatgtcagcttttgcaagttttgaaatggtttctggaactccatcctgtagcttgtcttcaatagctgtagctcccaggagctagaatgtatattaaaaaaaaaaaaaaaaaaaaaggaattagcaaacaaaccaaaagttttctgtaattacaggttgccaacctgtaaaaagaagggctaattatacatcctggttgctgctctcctggggccaatggccagtgttaacagggaaggctgccatgtttc

SEQ ID NO: 379395 - DNA, 378 bp, Homo sapiens
gacaaggcttatgtctccatctcagttcttccccataaggggaataccagactaggcagtggtgactggtagcagttgttttcttggcaattcaataaagacaatgctaagaataagaacactcaaggaagctaagtgaaggaaaaaagagctggggacagtggtgatcctggtgggagaggttggggtggggcaaagagcaaagcatgctccctgagcagcatgtcaggccttgcttctgccctccactgtctgccctgccttgacctgtactgcaggctgactgattaacaggcttccagcagctgtgccagtcaggtggccagggctgccctgcacaaccttgcttccttgcattcccttcagcaatgttcctct

SEQ ID NO: 379396 - DNA, 436 bp, Homo sapiens
ccaccacagtggttaaaaggcgtttgtatctgacactatgtgtgtgttttaaaataaacttttggaaacatgtttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaatttagaaaataaaaacaaaaatattaaaaatataagtaaagtgggtgtatatcgcctatatgggttaaagtttaaattaaaacagcgttattagctaagagaataaaccgtaaatacacaggcttatgataaacataaaatggcttagaacaaattcacttttagacagtttgttcactttgcaaggagcacggaaatggtgacgcgtaaatattatgtaaaattcctagata

SEQ ID NO: 379397 - DNA, 2761 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379398 - DNA, 3489 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379399 - DNA, 3129 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379400 - DNA, 3857 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379401 - DNA, 2658 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379402 - DNA, 2964 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtttctagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379403 - DNA, 2707 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379404 - DNA, 2707 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379405 - DNA, 3942 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgattcatttaagtaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctggggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagt

SEQ ID NO: 379406 - DNA, 3119 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaatttagaaaataaaaacaaaaatattaaaaatataagtaaagtgggtgtatatcgcctatatgggttaaagtttaaattaaaacagcgttattagctaagagaataaaccgtaaatacacaggcttatgataaacataaaatggcttagaacaaattcacttttagacagtttgttcactttgcaaggagcacggaaatggtgacgcgtaaatattatgtaaaattcctagata

SEQ ID NO: 379407 - DNA, 2734 bp, Homo sapiens
  misc_feature (2707)..(2707): n is a, c, g, or t
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcagggacagacttggacacaaaaccgatccatagaagggcttcccaaaccttgttttgcaacatcccaaattgtctccagttgaaggaaggncttatcagattatagtgagcttcattg

SEQ ID NO: 379408 - DNA, 2576 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttc

SEQ ID NO: 379409 - DNA, 2004 bp, Homo sapiens
cgcgagagcaggttaggagaggagaggaggccgcagtactgctcacacgctccgctcttctcccactctcggcctacctttacccgcccgcctgctcggcgaagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379410 - DNA, 2008 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccagggttaaggccaccggagggatcctcag

SEQ ID NO: 379411 - DNA, 1708 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcctccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttagtccgtccttggcctctccgtggacccttcctcacacggtataccccttctctcttcaatgtggcctctagctcaacggccgccctctccttcctctcctctgcttcctccctcatccctctcctcttctctcctcacttctcc

SEQ ID NO: 379412 - DNA, 1583 bp, Homo sapiens
  misc_feature (1431)..(1431): n is a, c, g, or t
  misc_feature (1535)..(1535): n is a, c, g, or t
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcctccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggtctgcccanccccacctaaccccctcttccctctacctgcaattcccccacctctccgcgctgctttcctgccgccccccagtcccccccccccgctctcgcgctgggggatnttcccgcaggtcccacgccctcccctcgcccagcctctcatttctcta

SEQ ID NO: 379413 - DNA, 5004 bp, Homo sapiens
  misc_feature (107)..(107): n is a, c, g, or t
gtttagtgttaacctcagctacactgaaggaatagaccttagtcctcacaagtataagttctagcttggaagcctgggttctgcagtagctgtggaacttaagcctntgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtt[450 bp omitted]ataatttatataatatatattagtcatatatcattatataaatatatatcgatatatatatttgtgacatatgtcatggtgacagggaaaagttgacaaattcatgcatttgaaaatcttttagaactaaattagtaacaatacaggcatgtggataagcttaatgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379414 - DNA, 3340 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctg[450 bp omitted]ataatttatataatatatattagtcatatatcattatataaatatatatcgatatatatatttgtgacatatgtcatggtgacagggaaaagttgacaaattcatgcatttgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379415 - DNA, 2707 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379416 - DNA, 2694 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcctccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379417 - DNA, 2758 bp, Homo sapiens
  misc_feature (2708)..(2708): n is a, c, g, or t
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaataactctcatgtaacaacttggtantggcaagaggattataatagttaataaaaaaaaagggggggcaaaaaacg

SEQ ID NO: 379418 - DNA, 2707 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagctacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379419 - DNA, 2066 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagctccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacgacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaa

SEQ ID NO: 379420 - DNA, 1822 bp, Homo sapiens
  misc_feature (1732)..(1732): n is a, c, g, or t
  misc_feature (1743)..(1743): n is a, c, g, or t
  misc_feature (1748)..(1748): n is a, c, g, or t
  misc_feature (1755)..(1755): n is a, c, g, or t
  misc_feature (1761)..(1761): n is a, c, g, or t
  misc_feature (1769)..(1769): n is a, c, g, or t
  misc_feature (1776)..(1776): n is a, c, g, or t
  misc_feature (1780)..(1781): n is a, c, g, or t
  misc_feature (1798)..(1798): n is a, c, g, or t
  misc_feature (1800)..(1800): n is a, c, g, or t
  misc_feature (1807)..(1807): n is a, c, g, or t
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtagggatatccatcantttatactaancttcntgttcanagcagngcatttantcccaanccannctagtcccacaagcaananaccaaanccattctctctgaac

SEQ ID NO: 379421 - DNA, 1269 bp, Homo sapiens
  misc_feature (1222)..(1222): n is a, c, g, or t
  misc_feature (1224)..(1224): n is a, c, g, or t
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtttctagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtgagtacattctgctgggccatctaatctcctcgtcggctagaaacttgggacgcgagtcatagctatctccccgctaatctcgtctgccggttananctgctatcctgttctctaacactgcctcaccgtgattgctgtctc

SEQ ID NO: 379422 - DNA, 2091 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379423 - DNA, 2824 bp, Homo sapiens
cctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaatgcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtagcccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379424 - DNA, 617 bp, Homo sapiens
taaacaggcacagaactaacgcaaggtacattctttaaagaggtgctcattctcagggctacacttgcacgtagctgcctcacctgcctagtcccagctctgctgctctggaaagtctcgggagcacatttttctccagtaatacgtgtggcctacattatcatttccaaatgaagaaatttgagactgggattcatcaaaatcacctaggaggctttttctaactactgtgctcgtgccgaattcggcacgatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379425 - DNA, 2097 bp, Homo sapiens
gatcctcacctacacccactccaccagcaccttggctgtgagccgctgtatgggaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379426 - DNA, 2131 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtttccttcctaataaaatacacgcgggtcgcccatgcaaaaacacaacaacacaccaacacacacaaacacccttccacgcccccatcgcgcccctgaaaacccttcacaacaccccccctaggccccccgcgccccatggccatcactcgcacccggcgccaacccgtgtcccccggggaccc

SEQ ID NO: 379427 - DNA, 1836 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtcgggctagtcggggctgtcgggctagtcggggctgtcgggctagtcgggg

SEQ ID NO: 379428 - DNA, 1962 bp, Homo sapiens
gattcagcagcctcccccttgagccccctcgcttcccggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379429 - DNA, 1996 bp, Homo sapiens
gaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379430 - DNA, 1987 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagcttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379431 - DNA, 1526 bp, Homo sapiens
  misc_feature (16)..(16): n is a, c, g, or t
  misc_feature (48)..(48): n is a, c, g, or t
tcgatctagaggatcncgggatgaggaacgtcactctacacagccagntctggtctgatggcacccaggaagtctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379432 - DNA, 1110 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgagcatggggtgcttggttgtttccttcctaataaaataaacgcgggtcgccatgc

SEQ ID NO: 379433 - DNA, 1315 bp, Homo sapiens
tttcttttgttttgttttgttttgttttgttttaaggctccccttacacaccctcctttaagctttgggttttggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379434 - DNA, 1133 bp, Homo sapiens
aaggctagtggaggcggggttaaatcggccgagggaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379435 - DNA, 880 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggggctcgtgccggggtcaggggtaccgagc

SEQ ID NO: 379436 - DNA, 450 bp, Homo sapiens
tactactactaaattcgcggccgcgtcgacgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379437 - DNA, 188 bp, Homo sapiens
aatgggggtgggatgagaagtagctgctcctaaggatcctcagtggaaagtaaacacaccactttcagatggtctagaaggtttctaaagcagacagtggggagtgtttctttatgcagggtgcctggtgacctgagtctctgctctccttgttgaccctcagatgaggtcatcgggcaggtcctgag

SEQ ID NO: 379438 - DNA, 2163 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcaaaaaaaaaaaggggggcgccaaaatattccgagggccagttaactacccgttttgtaaagggccctagggc

SEQ ID NO: 379439 - DNA, 2096 bp, Homo sapiens
aggacccaacattgtctatgtgaggccgcgtggtattttggccgaggtgtatgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379440 - DNA, 2098 bp, Homo sapiens
tccaccccccccacccggcgaacgtaggctagtacgagccgggtggttaattcggaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379441 - DNA, 2454 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcaaaaaaaaaaaaaaaaaaacaaaaaaaacttttgggggcggcctgggccctggaaaaagttttttaacaccattcgttttgggggcggggccccatgggttaattgcaaccttggcccctgacgcgtggtcccgaggaaagaatccgcggtcgagagacacacagcggccgtggagttttccacccaattaaaaagaacgccgcgggggcagagcggagggggttctgggaacacaccagagaggggggtccgggaagcacaacgagggctcctaccccacgggtccgcaggagccgataatcattagcgcccgcgggtgcaaaggagtaaagagagagagagagagaggaacagaacagaaa

SEQ ID NO: 379442 - DNA, 2090 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaaataaaccccaagatttccatgaagaaaatcagttgtcttcattcaagaattggggacatgttcccgatttgaggtgaaaccatgaagagaaaatagaatacttaataatgcttttccgcaaccgcttcttgctactgcaggctgaggctcacaaaggccagc

SEQ ID NO: 379443 - DNA, 1991 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggactatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379444 - DNA, 2086 bp, Homo sapiens
ccaggaagtagtagcaggacggtcccgctgtatttcgtccagggcggtactatgcgtacatagtggaccgttcgcgtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379445 - DNA, 1812 bp, Homo sapiens
cccaacacccccctccaccaaatatggcaaggataaggccgtggttaaggtggagggaagagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379446 - DNA, 1831 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379447 - DNA, 1663 bp, Homo sapiens
  misc_feature (130)..(130): n is a, c, g, or t
accctacgcgtcggtgccacgtcgttcggctgggagaagctctggggccggtcccttggcatgtggacctgtggcagccttgacggagacgcgtgaagcatcaactgccatgcctcgcctggctcttgcnggcttcgagtttgctgcgcgtgcctcgtacacgatgctcagcttctggtcttgaatggcacccatgggataggtccgtcacgatggcaatcggatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379448 - DNA, 1874 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagcccgtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379449 - DNA, 1198 bp, Homo sapiens
aatgatacgaatcgagctggtacccctagtttgagaagttacaatagcagctctactaaaatatgcaaagcaactcaaaggtgataagaacgaaattcaaaagttggttcaaatggcgagtggacatttgtaaatgacagtctcgtgcaccacctatgtcactgccagtgtggaaccagagaatcatagacagtagcagtgatgtatctcgctaggacgttggtgcaaatttagaaatacaagcaatggacctccaagacccatgtataggagatggtgggagcagagaggtcaaggtgccgggagtcccgagggtcgccccaaccgccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 379450 - DNA, 1096 bp, Homo sapiens
agcggacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatagccctagaacctaaaccccctaccacatcagatatgaaccatccggcaggcatgcaggattcaggacaggcagcacgattgcgcagcaaagccattctagagaattgccgttgtcatgccccagatcataagtgctcattgccacccagcagtatgcgaaatgccttccatttgcagccagcccgacggcaaacaaattgccattgcggcctaccccgttgccacagggtcgaggccatcatgtgacaagagaagcatcgcccaattggagcaaaccacagcaggatttgccgaaagatggctcactgttcgcaaaaaaccgttgctctcgggcaacagatcgccatcgcatcagaccctaatccggcggttgtccccgagcgcattcgggatcacctcgagccgtcaaaaggctcgctcgggagaaaagccccgcaaggcatggcccaggaaaagccaaaatacccggcccggccttgccagaccaaggctgggcagttcgcttttgcggcggccattggaaattccatgactctaggctattcgaagtttcttcttgctgcggcacccgagcatccccgaaagtcccgggcttccaatttcctcgcgagcttgtgctctttgattgtagcctttctctcccagttagcggaagaaagccataaacatctcctac

SEQ ID NO: 379451 - DNA, 458 bp, Homo sapiens
gcggccgcctactattactactgctcgaattcaagcttctaacgatgtacggggacatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379452 - DNA, 3138 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgatcagagaatgacctttggccttgggggccccccctgggtccaaggggggggcccccctggtttggggggcccccggggtttggggtggcaattcttccccgttgtgggggccttttcaacgccatagaatgcccgtagcttcaaggcggttcaccttggggttggacggatgccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379453 - DNA, 2974 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379454 - DNA, 3264 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgtttttttttttttttgcgttcgtggggttgtaaaagaaaagaaagcagaatgttttatcatggtttttgcttcagcggctttaggacaaattaaaagtcaactctggtgcc

SEQ ID NO: 379455 - DNA, 1962 bp, Homo sapiens
atgccactggtgtttatcgatgccactggtgtttatctgatgccactggtgtttatcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379456 - DNA, 3559 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggaaaaaaaaaaaaaaaaaaaaaaaaaaaaaaaaaacaaaacaagaggccagacacccaaacccaacatatactaagtcgagtaacattacaatgccctgcgctttacaacacaacgcctggaccataccgtgacccaactcaattgactcgcctcacatcccattttcgtcagttgacctagtatcaaagagaccaggcccgatcggattgcccaacacatgagcagcccagacggcaagtggcatgtcagaagcggagctattatgttgcctgtctcgacccattagtatataaatgaatagactcgactgagattggagtgagttccagtccagatcatgactccactactctaataacggaacgtgcaccgcaacaagggcgaggcgaccgtctcatatgtcagggggaccactccacttaaccgatcccttaccctagtcatttgctcttcgagcagccgtgccggaactaaatgaaaccctaccgtgccccccccttgctggcg

SEQ ID NO: 379457 - DNA, 1707 bp, Homo sapiens
tggccatagccgattcctgagcgaaaaacgacggcaccaagacctgatcgatggaatggctgttccgctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379458 - DNA, 2838 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379459 - DNA, 1310 bp, Homo sapiens
  misc_feature (17)..(18): n is a, c, g, or t
  misc_feature (25)..(25): n is a, c, g, or t
gggctaagtacgaggcnngggtgtngaatcggccgaggatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379460 - DNA, 997 bp, Homo sapiens
cgctggacacactgttcctgcgggtgcttcttggagaagtagatccatgaggcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379461 - DNA, 3052 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379462 - DNA, 3236 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggacttgtgattcagaggttttgaaagggtaggcaggcgtgggggagggaggactggctgagcaccacaggctcccctgcccctgctggggcctgcctttcctttcacccgggaccaagtcatgcatgtgcccagcctcaccccggcccccagtgcgtgcttggtcacacatacacacagagaattc

SEQ ID NO: 379463 - DNA, 2064 bp, Homo sapiens
gctcgtgaaatgggcatgcgtcctgtctcagagctgtccaagggctaaaataataactaacatcaaacgcctattatgtacaaggctccctgattttttctaatccttgtaacaaccccgagcaataattatttccattggcacaacggaagacaatgccagctcatcacagatcccttcccttcctctccccagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379464 - DNA, 3394 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaacaaaacacacaacaacaaaaaaaaaaaaaaaaaaaaaaaaaaaagaaggagagcgccgcgcggcgcgcgcgcggggcgccaacgaaaaaaaacgaggaagacccggggcggggggggcggaggcgacgagaggagagaggagaggaaggagggcagacacagacgaaggaaaagagggcgggggggggggggggggaggggaaaagaaac

SEQ ID NO: 379465 - DNA, 1734 bp, Homo sapiens
  misc_feature (6)..(6): n is a, c, g, or t
  misc_feature (26)..(26): n is a, c, g, or t
actctngagggtccacggcacgcggncagagatccaggagttcagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtgga

SEQ ID NO: 379466 - DNA, 2974 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccgggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactacgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgcccccctgggggctgggctgtagaagagttgttggggaaggagggagctgaggagggggcatctcccaacttctcccttttggaccctgccgaagctccctgcctttaataaactggccaagtgtgga

SEQ ID NO: 379467 - DNA, 1347 bp, Homo sapiens
ccccaccccgggggcggggcccttgcagtgacacgtcggacagctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctgggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgaggtgggatgataagctatcccactgatacctccttgtcatgttcaaatccctctgagaggcaaagggatgttggagatacaggtctgcttttccatgccaattcggacatttattttctatctctgtgacccccagtaaattactaaatatcctgggcttcagta

SEQ ID NO: 379468 - DNA, 976 bp, Homo sapiens
  misc_feature (12)..(12): n is a, c, g, or t
  misc_feature (899)..(899): n is a, c, g, or t
  misc_feature (902)..(902): n is a, c, g, or t
  misc_feature (904)..(904): n is a, c, g, or t
  misc_feature (908)..(908): n is a, c, g, or t
  misc_feature (915)..(915): n is a, c, g, or t
  misc_feature (924)..(924): n is a, c, g, or t
  misc_feature (935)..(935): n is a, c, g, or t
  misc_feature (938)..(938): n is a, c, g, or t
ggccaaagagcnccaactaggctaggtacgaggctcgggtgaatcggccgagggcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccatggttcggctgcgttgggattaactgnacncnccgnggtcacncaagccggngtcccggcccnccngggtgaggcctgggaacctctggccgcctgttttgcgg

SEQ ID NO: 379469 - DNA, 4919 bp, Homo sapiens
ggcgagtgggggggacagagtccaggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttccggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379470 - DNA, 4754 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379471 - DNA, 4980 bp, Homo sapiens
  misc_feature (4980)..(4980): n is a, c, g, or t
ggcgagtgggggggacagagtccaggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttccggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattaaaaaaaaacaaaaaaaaaaaaaaaaaaaagctctccgagtgctattttattcgtcgggggtgcgcgaaaacgagaggttaatcggtcatagggcgccagtgggctcatatggtgttgtttccctgtggccccaggtttttcttgttacctaaggtgtgaagacttcgcgcggggcctcaccctatatggagggcgcgtatttaatagtgtcgagtaaagcccgggtgttgacccgtgcttatgctgcgctgcgaaacgn

SEQ ID NO: 379472 - DNA, 4707 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379473 - DNA, 3927 bp, Homo sapiens
  misc_feature (12)..(12): n is a, c, g, or t
ggccaaagagcnccaactaggctaggtacgaggctcgggtgaatcggccgagggcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379474 - DNA, 4305 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379475 - DNA, 4689 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggacctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379476 - DNA, 4518 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggaaa

SEQ ID NO: 379477 - DNA, 4069 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctagcctactcagtgtgaagacgatgacgatgaagactttcatgatgatccacttctatttaataaataaaagatcttaccaacttccaaatgagaaaaatataggttttgctgttcaatagatatactggcagaaaggagacaag

SEQ ID NO: 379478 - DNA, 3866 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccgtctctactaaaaatacaaaattagctgggcatggtggcgcatgcctgtaatcccagctactcgggaggctgaggcaggagaaccacttgaacccaggaggcggaggctgcagtgagccaagatcgcaccactgcgctccagcctgggcaacaagagcgaaactctgtctca

SEQ ID NO: 379479 - DNA, 3500 bp, Homo sapiens
ttgagccgaaagagaaaataggctagtagaggccgggtggttatcggccgaggggcggctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379480 - DNA, 3427 bp, Homo sapiens
agatcgctccgcccccatccgcaggttctaactttggcctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaaccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379481 - DNA, 3540 bp, Homo sapiens
aggaagcttggggtttgagtttcttaactccacccattttgcttaagccccatccccatagggctgtagttctgagatgtcgtgccttgtcagaaacaatttgggagttttttaaaatatgaaaaagaacagatagagcctatcagacttaagaaggtgggatctagatagtatactaaaaatattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379482 - DNA, 3573 bp, Homo sapiens
gatactgagctagatatagcttgtgctttgctcagcaaaaaatattatacaaaaaggaaagcattcttaaattaaaataatattgtgttcagatagctggattagataaaaatccctctccacaaattttatcatggaggttttttaaaatatgaaaaagaacagatagagcctatcagacttaagaaggtgggatctagatagtatactaaaaatattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379483 - DNA, 2695 bp, Homo sapiens
  misc_feature (17)..(17): n is a, c, g, or t
  misc_feature (47)..(47): n is a, c, g, or t
  misc_feature (53)..(53): n is a, c, g, or t
ttgagaatttgtatttnttggagtttgaaacagtagggtggggtttntttgtnttgagaaaaatactgtctataattaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379484 - DNA, 2428 bp, Homo sapiens
gtcacgaggatctccgaaaggtagctgtactgcacctcctcatgccagcccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379485 - DNA, 3200 bp, Homo sapiens
  misc_feature (17)..(17): n is a, c, g, or t
  misc_feature (47)..(47): n is a, c, g, or t
  misc_feature (53)..(53): n is a, c, g, or t
ttgagaatttgtatttnttggagtttgaaacagtagggtggggtttntttgtnttgagaaaaatactgtctataattaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaagacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379486 - DNA, 1945 bp, Homo sapiens
ctctagagcggccgcctactactactaaattcgcggccgcgtcgactcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379487 - DNA, 1924 bp, Homo sapiens
atctgtctgatgagctaaggatttccttggggatgtcagtaggaccaaatgcccacaaggtccctcccccatggctgattgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379488 - DNA, 1609 bp, Homo sapiens
ccccgcgcagaagcatccactggtttatagaaaggcccagcataggcagcatgcttcttagagagtaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379489 - DNA, 1452 bp, Homo sapiens
gtgggttgaccgtggcttgtgggttgaccgtggcttgtgggttgaccgtggcttgtgggttgaccgtggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379490 - DNA, 1281 bp, Homo sapiens
taatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379491 - DNA, 1803 bp, Homo sapiens
  misc_feature (1726)..(1726): n is a, c, g, or t
  misc_feature (1729)..(1729): n is a, c, g, or t
  misc_feature (1731)..(1731): n is a, c, g, or t
  misc_feature (1735)..(1735): n is a, c, g, or t
  misc_feature (1742)..(1742): n is a, c, g, or t
  misc_feature (1751)..(1751): n is a, c, g, or t
  misc_feature (1762)..(1762): n is a, c, g, or t
  misc_feature (1765)..(1765): n is a, c, g, or t
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccatggttcggctgcgttgggattaactgnacncnccgnggtcacncaagccggngtcccggcccnccngggtgaggcctgggaacctctggccgcctgttttgcgg

SEQ ID NO: 379492 - DNA, 1593 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccaagagatgttcgtgcggcagcaggggtgcgctggagccaagagaaggctccccaatagggtatgcgacggcgggggaacgagcacgattcgggtgggagcggcctgggcaagtgaaggtcccaaaagccggagagcggggtgggggcacaacggaagtgacctgtgggtgaccaagggggtggaacggcccgggccagcga

SEQ ID NO: 379493 - DNA, 380 bp, Homo sapiens
gtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttctaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtga

SEQ ID NO: 379494 - DNA, 450 bp, Homo sapiens
ttgaaggttatttagaacacttcatacttgggggtggtggtcctgtttcttagaaatcaccagagacctgagtagaccagggatctgttttcttgtcagctctcaagttttttcttctttcgaattttgggagacagttaggagaaagtggaaattagtagtggcctggagtagaaattttctttaagatttgatgacaagatgactggtgggggtatggtaatggcctagggcctgaatgcctctgagaaagatggtgtgtatctatcttctgttggcattttttaactttctttattgctgtctgtgttctcatagcccactgatgatattgtcctaatggcacaaacgctggaaaagatattcctacagaaggttgcatcaatgccacaagaagaacaagagctggtagtgaccatccctaagaacagccacaagaagggggccaag

SEQ ID NO: 379495 - DNA, 4055 bp, Homo sapiens
ctcgagatccattgtgctctaaaggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattctttagagcacaatggatctcgag

SEQ ID NO: 379496 - DNA, 3388 bp, Homo sapiens
  misc_feature (2643)..(2643): n is a, c, g, or t
  misc_feature (2651)..(2652): n is a, c, g, or t
  misc_feature (2668)..(2668): n is a, c, g, or t
  misc_feature (2671)..(2671): n is a, c, g, or t
  misc_feature (2674)..(2674): n is a, c, g, or t
  misc_feature (2689)..(2689): n is a, c, g, or t
  misc_feature (2691)..(2691): n is a, c, g, or t
  misc_feature (2698)..(2698): n is a, c, g, or t
  misc_feature (2703)..(2703): n is a, c, g, or t
  misc_feature (2710)..(2710): n is a, c, g, or t
  misc_feature (2717)..(2717): n is a, c, g, or t
  misc_feature (2720)..(2720): n is a, c, g, or t
  misc_feature (2729)..(2729): n is a, c, g, or t
  misc_feature (2732)..(2732): n is a, c, g, or t
  misc_feature (2753)..(2754): n is a, c, g, or t
  misc_feature (2763)..(2763): n is a, c, g, or t
  misc_feature (2767)..(2767): n is a, c, g, or t
  misc_feature (2775)..(2776): n is a, c, g, or t
  misc_feature (2789)..(2789): n is a, c, g, or t
atggtgaaaagatatatatatatatatattcagaattaggcagctggactcagtttagatgatcccaattttgttggcaacatccaaagcatcgtaatcaggagccagtcgaacatatgccttcttctctccatcaggccgaatcagggtgttgaccttggccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttcgctttcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaagtttttttttttttttttntttgaganngagtctcgctttgtcnccnagnctggagtgcagtggngngatctcngctcnctgcaanctccgcntcncgggttcangcnattctcctgcctcagcctccnnagtagctgngacnacaggcgnncgccaccacgccnggcctgggatcttttttatcacgaatattcccaaccaccgtataatgtgaggctcccacatatccacacctatgaggccggttgcatagccatgctgctgcaagattcttgcaaaagtggtttcgttctcagggagtccacctgagcctgcgttccactgaagggcccggtatccattgctggcgtccatgcctgatctgaaggaatgtctccctgtgaggaatgcagctcggcttggggtgcagagcggggcggccgccaggtgctgagtgagcctcacaccttcctctgcaagctggtcaatattcggcgttctcagtgtattgttcccgtagcaaccgagatccccagtgcctagatcatccgccatgatcagtaggatatttggtttaaaggcatttgcagttttaggttcacacgtcttcagaagcaagcataaaaacagtagcaccggcaaagagtccctggcggcgggcgcggcgcgtcccctccgcgcggcggatcgcatggccgagcgctggcccagagcgcaggaccttgccctgcgcactccgcgcccgggcgccgctagtgccaaggcttccgccctccctcgtgcc

SEQ ID NO: 379497 - DNA, 4818 bp, Homo sapiens
tttcgaacgagcagaaatgtattggtaactgtaggtgtgagtggggagggattagaaaggtgcttggacgtgcaaatttgggagacgtattttagcttttgtggtctttgggactaaacagtagtaaataatgttttgctcgtctttccatcgtttggcttgagggagggagtggagtattataagactctggcaacactgttttagactgtggggcatgggaacgttagatcccctcatcgccgttctgaagcccgtagctgttcgccatagaggagcaggccgcggcttctaagatggcgtctttttcctcgtttcagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379498 - DNA, 4871 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379499 - DNA, 4846 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379500 - DNA, 4213 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379501 - DNA, 5259 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaagacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379502 - DNA, 4936 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379503 - DNA, 4137 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagccatttaggtacctaaatggctgtgaactggtgggtcattatgtgttgtcgtgcaggtagaggcttactagaagtgtgaaaacgtaggcttggattaaggcgacaggatttctaggatagtcaagtagaattagaatggtgaagatgataagtgtagagggaaggtcaatggttgatatggctaggggtggcgcttccaattaaggtgcatgagtaggtggcctgcagtaatgttagcggttaggcgtacggccagggctattggttgaatgagta

SEQ ID NO: 379504 - DNA, 3727 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgggccattcagtccgctgttcatggtcactagcatgtttcctattgtacggcgtccgacag

SEQ ID NO: 379505 - DNA, 3507 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaagtgagttagagtaggaagcagagactagtttggctatttctgtctctctgggggatgccatctctctttgcaaagataattctaaatggccagttaacagataca

SEQ ID NO: 379506 - DNA, 3200 bp, Homo sapiens
attcgtcccctgggggtacagcagccgggagccaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379507 - DNA, 2512 bp, Homo sapiens
  misc_feature (2)..(2): n is a, c, g, or t
tnacaaggggcctagggcaccccgcccacctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379508 - DNA, 2436 bp, Homo sapiens
ctgtgttctagagatcctgttcacgctcttgctgttactgagctctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379509 - DNA, 3320 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379510 - DNA, 1842 bp, Homo sapiens
caggttgtactccaccggcaggttgtactccaccggcaggttgtactccaccgacaggttgtactccaccggcaggttgtacgagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379511 - DNA, 3125 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379512 - DNA, 1923 bp, Homo sapiens
tggagacggggtttcgccatgttgggcaggctggtcttgaactcctgacctcaagtgatctgcccgccttggcctcccaaagtgctgggattacaaatctgagccactgcagctggcccatggtgtagtttggtagtgtttaagggagcagaaagacccatgtcagtatacctaaacaggtataccttgttttattgtgcttcactttacggagttttttttagatactacttttttttttagttgaagatttgtgacaaccctgtgtggagcaagtctttcaacagtttttccaacatgtttgtgtgtcacatttttagtaatattttttcattaaggtatgtacgtacattgtctttttaaagacatgttattgcctacttacagtcaagagcaaaatgctctgtttcactatacagtgtcccagtagcccacctcttacttggccattgaatggaaaaacagaagctccactctgggcaggaaataggatcactgaattataacagtgggaacatactggaagaggttaatgaagcttcttttgctgacaactctttttgcccttaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379513 - DNA, 2684 bp, Homo sapiens
ccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaagggacaggcaacggggtttccccccctattgcgttaaagaagagggagttggtcagccccattcaaggcccccaaggcaaaagaaccttggcctttggattcctca

SEQ ID NO: 379514 - DNA, 1164 bp, Homo sapiens
taatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgag

SEQ ID NO: 379515 - DNA, 370 bp, Homo sapiens
ctggaacgaggactgggattctgctttactttagcagacagtaggccatggagactctacaagtgggggcaatttgggggcaatttgatgagcaaaggcaattaagaacacagaaaattcttctcaatctttcacttcataaaggtggattaataaattcaggttcattctagaggtaggcaaacataagagggactgcaaaagattagatgataatgttgcctcccgagaagacttacagaaagtcttagaaccacattgtataaatctgtgtggattttaaagtgatgccaccttcctgtttatgccctccttcccacaatacacacttgtcgaaaggcgtagtcatgcaaaaatttaggcatatgga

SEQ ID NO: 379516 - DNA, 383 bp, Homo sapiens
agaggttgtttctcatgctgatgaaacagactaggactcttctacaatcttgtttctgacttttcttgagtgggatgataaaaattggagagctcctggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtgtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaa

SEQ ID NO: 379517 - DNA, 1941 bp, Homo sapiens
ggtcctctgtggtgcacagcccaccccccagccatgcgctctctccttctgggcaccttatgcctcctggctgtggccctggcagccgaggtgaagaaacctgtagaggccgcagcccctggtactgcggagaagctgagttccaaggcgaccacactggcagagcccagcacaggcctggccttcagcctgtatcaggcaatggccaaggaccaggcagtggagaacatcctggtgtcacccgtggtggtggcctcgtcgctgggtctcgtgtcgctgggcggcaaggcgaccacggcgtcgcaggccaaggcagtgctgagcgccgagcagctgcgcgacgaggaggtgcacgccggcctgggtgagctgctgcgctcactcagcaactcgacggcgcgcaacgtgacctggaagctgggcagccgactgtacggacccagctcagtgagcttcgctgatgacttcgtgcgcagcagcaagcagcactacaactgcgagcactccaagatcaacttcccggacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctatactgtgggtgttacgatgatgcaccggacaggcctctacaactactacgacgacgagaaggagaagctgcagctggtggagatgcccctggctcacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttatcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatgggagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttctcactgaaaccttttccagtgccaaaaaaaaa

SEQ ID NO: 379518 - DNA, 1500 bp, Homo sapiens
  misc_feature (1500)..(1500): n is a, c, g, or t
gttaccggtagcgaggcctgggtggcggtggtggaggtgacccatgacctgcagaaacacctggctgggctgggcctgactgaggccattgacaagaacaaggccgacttatcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttcaataaaacttttccaatgacaaaaaaaaaaaacacaaaacacaataaacaaaaaggaaaagcatataaaaacccctatataaaaatttataacacatttttctccaccccccccccccatcacaattccggcgaggtataaaccggggaacaccagtggagacgcgaatgacccaaatacacaggaatctcgcaaaagagatatatcgcagaggctcaaccgtttaacaaacgcgccctttgagagtaaagtgggaaaccgcgatcaacagaggcaaaaaaaagagccccaaacggaggacatggagaacacaccagacaacaacaagccccgcgagaaaagcaacgaagctctcgcaaataagaggggagagaaaaccccgagtcagaacacagacggacacacacacaggtctgcgacgagatgacacaaaaccgacacccccctccacccaccccaacaagn

SEQ ID NO: 379519 - DNA, 1264 bp, Homo sapiens
  misc_feature (1264)..(1264): n is a, c, g, or t
gttaccggtagcgaggcctgggtggcggtggtggaggtgacccatgacctgcagaaacacctggctgggctgggcctgactgaggccattgacaagaacaaggccgacttatcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttcaataaaacttttccaatgacaaaaaaaaaaaacacaaaacacaataaacaaaaaggaaaagcatataaaaacccctatataaaaatttataacacatttttctccaccccccccccccatcacaattccggcgaggtataaaccggggaacaccagtggagacgcgaatgacccaaatacacaggaatctcgcaaaagagatatatcgcagaggctcaaccgtttaacaaacgcgccctttgagagtaaagtgggaaaccgcgatcaacagaggcaaaaaaaagagccccaaacggaggacatggagaacacaccagacaacaacaagccccgcgagaaaagcaacgaagctctcgcaaataagaggggagagaaaaccccgagtcagaacacagacggacacacacacaggtctgcgacgagatgacacaaaaccgacacccccctccacccaccccaacaagn

SEQ ID NO: 379520 - DNA, 285 bp, Homo sapiens
aaagtctcacttttttccttgcatatttccttgcatatcgtatttattgtacataaatcttggcttccatcttcagagagcaaagtctttggtctaaaaactgagaaaatactgctcgatccttgcggtgggtagtgattagaagagggcaggacgcgggttcctagggtgcaagtaacgttctgttaattgatctgggtgttcacttggtgaaaagtctggaagctgtacctgcgacatcgcactttcctaatgtacgttatatttcaataaaagattttttta

SEQ ID NO: 379521 - DNA, 413 bp, Homo sapiens
tcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatag

SEQ ID NO: 379522 - DNA, 321 bp, Homo sapiens
acagaggtaaacacagatgtaaaactgtggctcgcagtaggcacttagtaaatggggacagtatgcatcagcccccgcctcccatctgtcccctgcatgtgtaggtgtctttgccatggccaagtccctggattctcttatttaaactgcaggcagaataggctttgctgtccttccttaaaatgtctgagtatggccgggcgcggtggctcacgcctgtaatcctagcaccttgggaggccgaggcaggcagattgcctgagctcaggagtttgagaccagcctgggcaacatggtgaaaccccgtctctactaaaatac

SEQ ID NO: 379523 - DNA, 294 bp, Homo sapiens
acagaggtaaacacagatgtaaaactgtggctcgcagtaggcacttagtaaatggggacagtatgcatcagcccccgcctcccatctgtcccctgcatgtgtaggtgtctttgccatggccaagtccctggattctcttatttaaactgcaggcagaataggctttgctgtccttccttaaaatgtctgagtatggccgggctggtctcaaactcctgagctcagcaatctgcctgcctcggcctcccaaggtgctaggattacaggcgtgagccaccgcgcccggcgtcgagc

SEQ ID NO: 379524 - DNA, 275 bp, Homo sapiens
ggcatcaaactgtatatagttttcacctgtattgtgaaatataacagatatagaaaaacatgaaaagcctatatgtaaagtttttgttgttgttgttgttgtttttttgttgttgttgtttttttgtagaagtggagtctcactgtgtttcccaggcttgtctgaattcctggcctcaagcaatattcctgtctcagccatatatgtaaagtttaacaaaaatgtataaaatgaaaacctgtgtcaccaccgaccaggtcgagaaatagaatgtt

SEQ ID NO: 379525 - DNA, 640 bp, Homo sapiens
agttgcaccctaccctgtaatgcccaatatcattgccctttgtcttcctttcattttgctgttccatatctcagaggaaaagggaaatacttctaatttctccatatctctaaactctgagttccaactacatttgtatatagtaattagccaacactttatattcatggaagctaaagaaacttagaaaacacatttccttctcccaaagcctggctttcaaaatcatgatcttgctgcgtgctccagaaattcagctttgtgagtaaagctgatccatcacacctttgctggaggcagaactgtcctactgtcccctggggcaagaggcctcatggctcagcctcagaggtggaaggctggaagggaccatgataccaaagcggattaaagtgcattgacttcacatcttcaaaatattaccaacaaatatgtacaaaaaagccctccttaggggtataaacaagtgtaagtaaactctccttgttcctttctctgaagctgtcttccttgcagtctaagaatcctgtgctgtatttggtcacaaatttccagtctataattttgttgtagccctttttaatttttgcagccagagtgggagagactcaagcttatcaacattttgcatcttgacaaa

SEQ ID NO: 379526 - DNA, 866 bp, Homo sapiens
cccgctcctgctatcttcgtcgtgcttctctctcggtggtgccctatcttgtgtggactcctgatggtctgtggcgactggtgtgagactccggctcatggggctgttctgcgcgagtgtgtatgcgcttgtgcgggggttatgacggcctgaatgggcgcctttattagcgccgcctgagttggggcggtccttcaatatggaggttgtaccgtttgtaccttgggcccccctagatgggatgcgcaaatttgtcataagggccccccccggtaacacaattttttgcgctttggggaacacaaggttctcggcccaaacttacctcccctgttgggccaagtaccccgccttgggcgaggtccaaaccaaatgggcatggctctgcttcagtaaaataataaaattactttgtaaataaatataaaaacaggtggttggctggatttggtcatggagccatagtttgctgatacctgatctaaaataattactgccacgttgatctttagatctgtctcttttgcttgctttgaaaaaaaagcataacatctaggaaatactaagagctatccctagtttttcctttgcatcactctacttcatgtcttctgcttccttttattcctctttgcagctcgtgatgcgttgggtattaaacacaccatggtgaagattcgtcccttgtcacaggccacaagagcagccaaggccaaagctagagcttatgctggtgagtctataatctctgggtttttttcttgctgatggtggtattattgttctttccagaagttttatagcatccagacatctaaagacatatcacttttatttttagtgttaaaagaaatatgtttttaaga

SEQ ID NO: 379527 - DNA, 457 bp, Homo sapiens
cacccatttctgcttcttgaaaggtagtatatctcaaggaaactatggcttagtatgttggggttggggtttagggcgtggatattatatggtcttatacttacaacaggaactggtttcaagaagcaggaagacttccagtgtcctactattgaagcctgcacctgctgcattgctgttttcctggtatgatttccacttgttgttatccttagatttttctctcctgggtttggttctccgaatatcgttagaactcatatcttcttcagacttcatttacctcttgcttaggtggatcacatcctctagtagttgtgttggattcaaaagatggtaccatgccagagagcatgaggatgacagccttcagcatgcctgccctctcacatagcttcaatctggattggttgccttctgctgctggtgcacagttaccatcctagagtcccattcg

SEQ ID NO: 379528 - DNA, 3557 bp, Homo sapiens
gagcggccgcgcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggctttggtatcaggatgatgctggcctcataaaatgagttatggaggattccctctttttctattgattggaatagtttcagaaggaatggtatcagctcctccttgtacctctggtaggactcagctgtgaatccgtctggtcctggactttttttgttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactccaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacataaaaaaaagtggt

SEQ ID NO: 379529 - DNA, 3249 bp, Homo sapiens
gagcggccgcgcggagacggcggaagcggagagcaacagcgcgccgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggctttggtatcaggatgatgctggcctcataaaatgagttatggaggattccctctttttctattgattggaatagtttcagaaggaatggtatcagctcctccttgtacctctggtaggactcagctgtgaatccgtctggtcctggactttttttgttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtaacaggagtgctgacgttggtaccgagctcgattctat

SEQ ID NO: 379530 - DNA, 260 bp, Homo sapiens
aaccacaaagccaggcatggtggcatgtgtctggtcctagctactcaggaggcagaggtggaaggatcgcttgagcctggaagggcagaggttacagtgagctgagatcgctccactgtactctagcctgggtgacagtgtgagactctgtcccaaaaagaaaaaagaaaatattttggttcaatacattgtaattagtgtctaataattaaatcattcttctcttgcagattgtggtggtgccatgcagcaagaatcag

SEQ ID NO: 379531 - DNA, 3502 bp, Homo sapiens
gagcggccgcgcggagacggcggaagcggagagcaacagcgcgccgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggctttggtatcaggatgatgctggcctcataaaatgagttatggaggattccctctttttctattgattggaatagtttcagaaggaatggtatcagctcctccttgtacctctggtaggactcagctgtgaatccgtctggtcctggactttttttgttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactccaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacataaaaaaaagtggt

SEQ ID NO: 379532 - DNA, 3409 bp, Homo sapiens
gagcggccgcgcggagacggcggaagcggagagcaacagcgcgccggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggctttggtatcaggatgatgctggcctcataaaatgagttatggaggattccctctttttctattgattggaatagtttcagaaggaatggtatcagctcctccttgtacctctggtaggactcagctgtgaatccgtctggtcctggactttttttgttatcagggaataccaagagcagagagagcatccaggaacctagatctgattactacaatcatgaagttcctgatattgacctcagtgattgtgaattcccacatgtcattgaaatttatgactttccccaagaatttcgtactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactccaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacataaaaaaaagtggt

SEQ ID NO: 379533 - DNA, 190 bp, Homo sapiens
ggtcacacaaaatttgaatagatcttttcatgtatatttcttagccacctcattaggaaatgttttaaagctgaattatattttgtatctgggatcccatttatagccctagagatgatgttattcttctgaaatactaaaagaggccagctgtggttgctcacacctgtaatcccagccctttgggagg

SEQ ID NO: 379534 - DNA, 1853 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagtaagtgcggaggataaaccagcctccttcctttaacccagctgcactgcgttgtcgcctctcacccgtttagaaacttctggtggacggccctggtggtgaagaggcgagggccgttcaggaagccagcccgctccgc

SEQ ID NO: 379535 - DNA, 5045 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379536 - DNA, 4991 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379537 - DNA, 5309 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcatcttggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379538 - DNA, 4846 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagtacgtgtcactcaatagctaagttgtctgaaggatgggatagtatgggttccggagcacgcaggggtgaattatgaaaaactttaaaaggtctaatggaaggcaggtgtcagaatttgaaaaaagcgggttcagaaaaaggggttagcacaggggttttaaaaagcgcgggtgtgtttccaaaatgaag

SEQ ID NO: 379539 - DNA, 5380 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacacgtgtataagaagtaaaaatgggccaggcactgcggttcacgcctataatcccagcactttccgaggccgagtgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcatcttggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379540 - DNA, 4942 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379541 - DNA, 3206 bp, Homo sapiens
gagaagattagcatggcccctgcgcaaggatgacacgcaaattcgtgaagcgtccatatttttggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379542 - DNA, 2781 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcatcttggtaagtttgttttataaatgtgcagttagaatttttaaattataaatagattatgcttctgattatacagcaggcatatgaaaagtaaaatgttttctaatttcacaactattttgtggtattaaaacattgggtgttttactgaatactaaattgttcagataaacatacaaagaaggaaatattataaacacatgcattatgtaataggtaaatacctaaagttatatcaattgggtttttaaaaatgaaatcatttgccaggcatggtagcaggtacctgtaatcccagctactcagaaggttagggggaggatcatttgagcccagttcaaggctgcagtgaaccatggtcacacatataaatagatactacactccaatatagcaagaccccatctctaaaaacttaatcatttgaccaggcacagtctcaggttgcaatgagccgagattgtgcctaggcaaactccatcccccgacaaaaaaaaaaaagtcgacgccggaattagtagtagtag

SEQ ID NO: 379543 - DNA, 405 bp, Homo sapiens
cccacctcagcctcccaagtagctgggaccacacttggtgctaccatacccatctttttgtagaggcagagtctgtctgtgttgtccagcccagtcttgaactcctgggttcaaggggtcctcctgccctagtctcccaaagttccaggattacaaggcatgagtcactgcacccagcctcattttttaattaagttaaaatttctgagcattctttaataataaaattattttatttatctccaggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtca

SEQ ID NO: 379544 - DNA, 352 bp, Homo sapiens
aaagtcagtttatattgatatacttggaattaactgttttctctttgataggtgtataagaagtaaaaatgggccaggcactgcggttcacgcctataatcccagcactttccgaggccgaggtgggtggatcacgaggtcaagaaattgagaccatcctggccaacatggtgaaaccttgtctctactaaaaatacaaaaattagctggtcatggtggcacacgcctgtagtcccagctacttgggaggctgaggcagaattgcttgaaccccggaggcggaggttgcagtgagctgagatggcgccgctgtactccagcctggcgacagagactccatctcaaaaaaaaa

SEQ ID NO: 379545 - DNA, 5094 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaccctattataaaaatagcttcagatgtgcaaataagactgcatcttggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379546 - DNA, 5116 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacacgtgtataagaagtaaaaatgggccaggcactgcggttcacgcctataatcccagcactttccgaggccgagtgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379547 - DNA, 5014 bp, Homo sapiens
gcgcctgtaatctcagctactcgggaggctgaggcagagaattgcttgaacctgggaggcggaggttgcagtgagccgagatcgcgccactgcactccagcctgggcgacagagtgagactcggtctcaaaaaaaaaagaaagaactccctaactcttctgcagtagcaatgaatatatttgatactaaaatgttttcattttcctagtgggccatttactgtcaaatgaatgtccttaacttcaatttacagtagttacccaaaaaaggctatcttcactgactatgcatacctagaaaagcacatcatcctactcaccgaccttaacaacatcatctttcggccctaattaacaatgtgtttgtaggtttgcacacgcacacccatcaaacgaaggacaagtgttcttttataccctatgtatgtgatacaatgggctgtagtcgaaaaagattcctcattttggaaagaagtcataactttatgtagtagtctcctgtctcaagatcgcttgacacagctaatcttacatccgtctgaaagaagcgggggcgggggtgggggacggaagtgacagtttcctctttttttttttttttttttttttaattttatagagacagtggctcgccatattgccaaggctggcctcgaactcctgggctcaagcaatccttccgcctcgacatcccaaagtgctgagataacaggcgtaagccactgcgcccggcctcctatttttcatcaaataaaatacaaccgttcagagcagcatgctcagcaaccacgaggaccagtcccagcgcatccaaggtgccgggagggaaaggaacagaactcccccaggtaagccggtttccccacgccaaggcgcagtcgctcaccacccaaatcgtcgctggggagagacccacccggcgactgcgcgcttcgcactcgagtctgcgttaggaagcctctgaccctttcccgggcccctgcgcgtggaagcctcggacacaactcggagaaccagcgaaccccggcagcacagaattcgaaccgccgcgggagccgttgggacgcgcctacccggtcactgccccgccccggcgcagactgcgtgaggcgccgccggaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379548 - DNA, 3307 bp, Homo sapiens
cacgaggccagtaggcactttcttactttttgcagacagtttttcagatggagttcacactgttaacacggacctgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaattctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccgcatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgcca

SEQ ID NO: 379549 - DNA, 333 bp, Homo sapiens
actaattctataacagtgtccagaaatctctccttcgtaattgtagtcatttaaaacatacctgtactgtattacaccacaaacttttcatattctctagaaatttacaacatagagagttcactgtttagccttgcttttctaggtaactgcatactcagaaatactgatatattttagaatcatgtaactttcgatttgaaagaggtcattgcagatctcactgacaagtggttttaaagtcatggtgtgtggaattcttggcactttagaaggagcatgggtgggaagaggagagtgggaaaccagactgtctccctttttcatctccaa

SEQ ID NO: 379550 - DNA, 392 bp, Homo sapiens
accttctatgtgtttccaaaagcaaaagaaatgaatacatttctggtgttggtgttgtttgaggatgtggctaaggacttcacttgggaggagtgaccagatctggatgatgcttagcagaccctgtacagagacatgatgctggagacctacagcagcttggtatccttgggacactgcattaccaaacctgagattatcttctggagcaaggatcagagccatggacaaaagggcccaaaacacagcctcccagccatgtgaaggtgcctgctaccactttgccttgtgccataagtcagagttccctgagacctccccagaatcagatggtgccatgcttcctgtacagcccagacaatcgtgagccagttaaacctattttctttata

SEQ ID NO: 379551 - DNA, 889 bp, Homo sapiens
ggcacgaggattaccccagatccagaaagatggctgccaatgcgagaacgttcttactaccggggaagaaagaagggtaaaaagaaggatcagattggaaaagggacccagggagcaactgcaggagcttcatctgaagtggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaaacacagaactgctccctcttcatctccgtattttcataatttcttgtgtttcaaatggggaaacatcttcctcaaaggctgcctagtgagatatggcctactggttgcctcataactttgtacagattatgaggactgaaaataattgggcatttacccatcttggtatctgttgtatcctttatctgtgtgtgctgattcgatcttttttcagtttcacataccttatctaaggtttcccaggatttaaacagaaactatttctacgatttcagctagagtcagaagatacttgtttctgttcaagtctcactttaaattatgtcttaggaggccttaggcaactgaaagtggaatcttctgagcattcctaaatatctgcttagaaatatcatgtgataaagagg

SEQ ID NO: 379552 - DNA, 361 bp, Homo sapiens
tggaagaaagacttgaagaagttattgaatatatcagagagaaacagattgaaaacacacaaaaaaaatggtttaaaactgtaaaggacaaaaagagaatgtcagacatatgtgtaatcaaagctccaaaaaaaaaagaagttctaagtcctcagattcaaaaagctggtcctaaccaagatatataagaagaaaactccactgctagacatatatcattgctaaactagaaaacaagacacaaaaatattaattataatggaaagggacttcaacagcaatataggaagccagaagacaacaaaatgacatctccaatatgaggttagaataaggacatcttcagataaacaaaactaag

SEQ ID NO: 379553 - DNA, 5147 bp, Homo sapiens
tgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379554 - DNA, 4977 bp, Homo sapiens
tgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379555 - DNA, 4142 bp, Homo sapiens
cttctgacagactgtgtgggtttgtttttgtctcctgtccagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379556 - DNA, 3880 bp, Homo sapiens
actctgatttactccttgtgattatttgggaaacaaatcagaagaaaacaaaactggtttcctttcctctcccccttacattttttatgacctatcttaactttggcaggttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379557 - DNA, 1601 bp, Homo sapiens
  misc_feature (20)..(20): n is a, c, g, or t
aacggcagtactccacgggntatgtagcgaggctgggtggcgacaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379558 - DNA, 650 bp, Homo sapiens
tgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggtgagagagcccggatgcagggggccagagctggccggggacacggcggggagcagagggggctttaccccaaagtgacaccagccgcgtcgcctccctcctgtgctcagttccccagggtatacaaagtggaaagtcagagcaacaagggagacgaccgacaaataagtttggagcttccactttgagccgggcactagggacacgacccctgccctcaagcctcatcaagttatgcactgcccagtaggggaggcagaacg

SEQ ID NO: 379559 - DNA, 5094 bp, Homo sapiens
tgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379560 - DNA, 5186 bp, Homo sapiens
tgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaaaaaaaaaaat

SEQ ID NO: 379561 - DNA, 398 bp, Homo sapiens
  misc_feature (184)..(184): n is a, c, g, or t
agcaaaaaagccttgaccaagagcttgggtctccttcggacctgcacacgactccccaactcccgcctgcaacggcgcctcttggatcccgggcaggcagcgtccacccagcgtggaaccgtggcagccgcagcccccgcaggttggagggcagacactagcaggagaaaggccacaaggctgncgtggtgggaaagcatgggagacgtcgctttcctaccgggcgagaaggtctccctacagtctttggagacaagatggagggaggcaccccttccaggaacaaggcggctgctcctgaggcctggctccgcacggaggcttcctggggtcccgcgcgccctcttccctacccgctgttagccagagttgctttcacatatcttcaaccggcttcc

SEQ ID NO: 379562 - DNA, 1107 bp, Homo sapiens
  misc_feature (1034)..(1034): n is a, c, g, or t
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactggcttcaacttcnatccggatgcgtccctcatctgggtatccagggaacacggcatcttcatcggcgaaaacggcatcttcatcgg

SEQ ID NO: 379563 - DNA, 2710 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379564 - DNA, 2614 bp, Homo sapiens
aagtgactggtaccggcccggaggttagggatagagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacgatgctttgcgtgtgggatggaaaatggattccggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379565 - DNA, 2509 bp, Homo sapiens
aagtgactggtaccggcccggaggttagggatagagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379566 - DNA, 2808 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaaggaacagagaaatgaaatgggaagagattatcggtaggaaaaacagtggaagacagggcttgagatcttggcctttgagcggttctgtaatctcacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379567 - DNA, 2543 bp, Homo sapiens
gttgcagtgagctgaggttgtgccactgcactccagcctgagcgacagagtgagactccatctataaaaaaaaagtaataataataataatgcaaacgcttgagccagatcgaggatattctactttcagacttttcttattttttccagacacagtagcataaaaatatcacttctgtctgttttgctcggttctgaacctagatggagtgtttgatgatgtctctctgaacctcagagacgtctcttaggctgaccttcacccaggcgagaagcactccctcagcagagccagcccacgtgcactcgccgagctccaggcctggcgctggctacctgcctccagagctttttcttcaggaacactccttttctgtgtggtattttcagtgtttctcagtttcagtatgataagaacaggagcataaaatgtttgggtttgactcttgaggaaagcaactctgatcatgtttttctttccagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379568 - DNA, 2735 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaaaaaaaacacaaaccaatacatggcg

SEQ ID NO: 379569 - DNA, 2656 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaacccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379570 - DNA, 2207 bp, Homo sapiens
gcctcacctttttgatggccggattcccgtgctgcttttcctagctatctgagggacttaggattcggacagtgcttctcagatgagctccctgtgtagcaggagcagggagcctgggcctgggtgttcctcctgggtctcagccagggatgcgggcatccagggtcagtccaccctgcccggtcaggaggttgtctctggaagcctctcttgacttgtgcccagtgccgtgggaccaggagccaccaaccaactcgttctcaggggcacaactgtgtgctggcagttggaggagaaagttaagtagtagatgatgtgggtgagtttgagaaaggcttgtgtggactaatggatttgtgaatgtgagtcatttcaaaaactaacgaaaaagttttgaatctttgataatgaaacacttcactgtttttcaaaggggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379571 - DNA, 2740 bp, Homo sapiens
  misc_feature (2716)..(2716): n is a, c, g, or t
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaaccacancacaaaaaaaaactctccagcgct

SEQ ID NO: 379572 - DNA, 2456 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379573 - DNA, 2219 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379574 - DNA, 2381 bp, Homo sapiens
gggcgtggtggcgtgtgcctgtaatcccagctactaggcagggctgaggcaggaggatcgcttgaacctgggaggtggaggttgcagtgagccaaggtcgtgctactgcgctctagcctgggcaagagagcgagactctgtctcaaaaaaaaaaaaaagaaagaaaatgtaattaatttataaatacggcagctttatctgtgaggtcctgggccttgtggtgtgcatagcacatccctgtctgctcctagaacagacagcacacggccaatgcctgccccagcccagctgacctccataggggcagcctgcaccttcctgaggccaggatcattggagagaatgtgtgtttctcacccgagtcttgtgagagcagccctgagcggcatgttgggggtgtggtctgcaagaagtcccttccctctcccagacacacagctcatcagctgcatttgtggggcacccaaggaaaacttgccgtgatacactggattgtggctgtggctttgtggcttcaacctgtggtgctgtggggatggttgtcggcttgttaaagaaagggcagtattcagaattggcacctccagagtgggaatgttgaggtgttccacagtgtcgacaagtgctgtgggttaagtctctggactcctccacatccacacaaggcctgagctgtgctggttttctctgcagcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379575 - DNA, 1081 bp, Homo sapiens
tagtcgtcagaggatcccggtgtggcaggggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379576 - DNA, 1174 bp, Homo sapiens
  misc_feature (1062)..(1062): n is a, c, g, or t
  misc_feature (1065)..(1065): n is a, c, g, or t
  misc_feature (1071)..(1072): n is a, c, g, or t
  misc_feature (1074)..(1074): n is a, c, g, or t
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactggcattcaactttcaatcagggatggcgttcctcaatctgngtnatccanngnaccagggacagggcatattttggcacgccgcagatcccaaaaggcattaacccggccagttggcgcccagccgggttccttccaaattctctcaggtcca

SEQ ID NO: 379577 - DNA, 971 bp, Homo sapiens
  misc_feature (859)..(859): n is a, c, g, or t
  misc_feature (862)..(862): n is a, c, g, or t
  misc_feature (868)..(869): n is a, c, g, or t
  misc_feature (871)..(871): n is a, c, g, or t
taactgctaggtacgaggctgggtgttaggggagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactggcattcaactttcaatcagggatggcgttcctcaatctgngtnatccanngnaccagggacagggcatattttggcacgccgcagatcccaaaaggcattaacccggccagttggcgcccagccgggttccttccaaattctctcaggtcca

SEQ ID NO: 379578 - DNA, 2527 bp, Homo sapiens
  misc_feature (1)..(1): n is a, c, g, or t
nccgccccccgccactcgcgaagaacacgtcctggcgcttacagggcagcagagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379579 - DNA, 2676 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379580 - DNA, 2650 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379581 - DNA, 2574 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379582 - DNA, 1918 bp, Homo sapiens
aggctctgttcttcctctgggcacgcacacgggccatgtcactgtgaccacagagcaccggacgacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 379583 - DNA, 3056 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagtcctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaaaaaaaaaaaaaaaaaaaaaaaaaaaaaaaaaaaaaaaaaaataaaagaaaaaaaaaaaaaaccccaaacataaaaactattaaaaaacacgtaatacaaaaaaggcaaaacttaaatatccaaaataaaaaacaattttggcaccccttgtccacatccttttttatttacgggtaattttttttctggggcccaatttacctttttttggaaaattccccctattacaggatttgaattaaacaacactgcggggcgatatttacacactttctaactggaaaacatttggggtttgccaacatataaacccttttgaaaaaaaacccttttattgggcaatttt

SEQ ID NO: 379584 - DNA, 2247 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaacgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggatgcaacttccgctggttgtgggtggccctgtctggtcctccagcccccaggtccc

SEQ ID NO: 379585 - DNA, 661 bp, Homo sapiens
ccctgcctctccccgcctttcctcgcctcgcctcgcctcgccccgccccgcccctccccgccctgcctcgcctcgtctcgcctcgcttcggttagatgcgctcggcgctccataggctccctggtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaggttgcccagaagaaaaagatatcccagaagtatctgaagaaacaaaaacttatggcgctgtttgtactctg

SEQ ID NO: 379586 - DNA, 491 bp, Homo sapiens
tttcatgctatagaaattatacttgatatattctattagtatatttctaaaatttaattggatagccattagaaatggatcttctaacaaaataacttatgagattcttagctattgaaaaataatgaagccatgctgcttatagatttgaaacacagtcactaaatgtttagatgttatgtccatagcttagtgctattttaaaaaatatttattttagaattatttgagcacctacttggtgtcgagctctattctaggtgctggggatgtggtgttgaacaagataggcaagatgtccactctcctggagcttaagctttagtaaggaaagagaaatgaaaacatcaggataactgctttgatgaaaattgggtaatatgacagaaaatgtctctaaggtatagagctgatttagattgggtggccaacaggcttctccgagagagtgatgtgtaaactgagacttggtgaccagaagcagccagcgc

SEQ ID NO: 379587 - DNA, 1025 bp, Homo sapiens
ctttatcctaagtctgaaaattcatatcaaagaaaattttatggatgtaaattgttcagatcataattgtcaaaaatgctgggaaaggttgggagaaattttatttctaacacattccagaaccacattttctaaccacagtgtagtaattttatcaagagcaaaagttatagttttcttacaagttaaaaaaacagccagattatcatttgcttaacaaagaaatcatgcaattaccataaatggtaatgaaaagaatgaattgagagtttaacatgccaagagatgtgaaatgtggccaaagagatgtgagggtaaggggaaagccaaagctacactggaggaatttttatagcctttgaatgcatgcatatacatgaaaatctgaaagataaactcatatgcactaaacatgctattcaagtctaccaaacatccaggcagtgaaagaagaaagtaacagaaaatgatgaaataaagagaccatcttacaataatctcagtttttgtttctttctgatccagaaataatctaaatttaggagaatatttcttaatttccacattgttacattgttttatgtgactggcacagacaaccattggttgtcatcccagcagccatacccaattccccttgttattggcagcatctgtgtcttgccttggactctgagaatatcagatgctaattttccagtctcctgtgcagcacagtatggccagtatctcccagtgttgctcagtggaatctgccggggcttctgggaaagattttcctcattcagaagagacaggtttatcatgaagacttcctcctctctcacttcctgcttttaaacatttttatataagaacatgatgcctgaagctgctgcagctgtcttggaaccaagaagagaaaaaagtggacctcagagaagctgacccagagcctgagaagactcagctactaggccaattctggaactgcctttttgatgccttgttatctgagaaaaataaaacttgattgctcagttagt

SEQ ID NO: 379588 - DNA, 517 bp, Homo sapiens
ggcccctcctctcatctcctttccaatgcagcttctagaacattccccaaggatccaccaacactctccggtccccaccctggcccagcctggcatgaacctgctgtttgcaacccacggcctccttggagcaggggttggggggtgcctcccaaccctctgccggagggttttctctccctccggcagagcagaaaacggtggcatagattggtcaagacagtgttcgtgtcagagcacagaaaggcatggatggggccgggcatggtagctcacacctgtaatcccagcactttggtcaggagttcgagaccagcctggccaacatggtgagaccccatctctactaaaaatacaaaaattagctgggtaaggtggcaggcgcctataatcccagctactcgggaggctgaggcaggagaatcacttgaaccctggaggtggaggttgtagtgagccaagcttgtgccactgcactccagcctgggcaacagagcgagactctgtctcaaaaaaa

SEQ ID NO: 379589 - DNA, 422 bp, Homo sapiens
aggccacaagcatgcaagaagtgtgttggagccacagattgccagacctggctgtggagttgcatttttcaactaagaagtagaaggttcaggtgcctttgatggttaaccaggcccagcgttggtgagtgtaccagaaagtttggaaaacaggtcgaagtggtagagataaaaatctactgcagttgaatttgttgaaaagcccaggacatgcctcagggacctgcgtttatccatttgctccaatctctttcccagcaatcacttaacatttgggggagttggaggatagctgggagtgggcatgcaacagcttgtaaggagggagaggcctgtggactgtggactggacagggtgtccactctttgaatccggcctcggcagtctgcaaaaataaattcaaaaatgctctttgtcatct

SEQ ID NO: 379590 - DNA, 302 bp, Homo sapiens
ctttatgcatatgcctccagagtttgaatcatgcaaagatgctgccacttaaaaacctctttcctacaaacttacacccctccgatcgtggttttcctgtgaatctcagctgggcacgatggctgacgcctgtcatcccagcactttgggagactgaggcaggtggatcacgaggtcaggagttcaagaccagcctggccaagatggtgaaatcctgtctctactaaaaatacaaaaaatagccgggcacgttggcaggcacctgtaatcccagctacttgggaggctgaggcaggagaatc

SEQ ID NO: 379591 - DNA, 452 bp, Homo sapiens
attggttgaacccgggaggaggaggttgcagtgagcccagatcgcaccattgtgctccagactaggtgacaagagtgagactctgtttcacaaacaaacacacaaacaaacaaacacacaaaatcttggctgctggcaaccaggcacagccaagtaaggtgagggcagaaagcagatacttgcaatccatggtgcatcagcttttttaacatattttttctccccaactacatagaaaatatcctaagtgatctcatgcatctttgaatccaaacatctcattttttgccttatccatattacaaacgtattcacaatttataatgcataatcaatctattggaaaatattcaaaacaaatgcattctcttcatggaaccaagtagtacacctgaattaaaatttgtattgagaattattagtataataattttttaaaaaattattaagta

SEQ ID NO: 379592 - DNA, 386 bp, Homo sapiens
cagagacagtctgcctacctagagttcctctgatagcaggatctaagattcttctgccttctgcctattgttaggggaaaaccctcatttcttttcggggcctcaccagagtgacactcttggactctcccatgccttgctccttcccaaggaaggcagtgtgactagtctgatgaatctagaagaaagtgaataggctcacctcagctcagccctcttgggcactctttcttttgaagccggcctccccgaagagacctctagttgtcaagctgtgaactgatggacaggtcatctacctaatttgcagctgaagcagaaggtcacagacaccacatcctccagcccagctgttatcagtaataaagtttacatttgggtctcca

SEQ ID NO: 379593 - DNA, 342 bp, Homo sapiens
aaatccctaagtggaccagtagggtccctatcaagatgcctacttgaggaatctgccagttccagcccactgagtctcagagcagtggttagagcagacctacctgattgacacatgccccagttagacctgttcacaacatctgagcacctgacctcatgccaaacacctgttaaatcctcaacaaatgtttgtgtagtaaaggaattttttttatgtgaatgggttttaagcctagttacagtggactgatagcccatgaatagcttggttttggtttttattttgtttttgagacagggtctcactccagcctgggcgacagagcgagacttcatctca

SEQ ID NO: 379594 - DNA, 330 bp, Homo sapiens
tataagctacagaaaggcagaagccatctgaattcccctcttattttagctttatctcctagtaacagggccaagatggtgactcaggaagagcacagcctctgaagttagaagtcctaagtctatagaatattagttgattaaatgcatgaattcccaagtgcaatgcatcacccagtgatccactatcttgaaccaactgcaactcccaaggtcaaaagtttccccatggaatctgtagagattttcatgttgctctaagtggggaactcgtttggacagcaagctgaacccctaacttctgtcacctccccgagtccagtccccagt

SEQ ID NO: 379595 - DNA, 419 bp, Homo sapiens
acagctaggaaaacaggtctgagtctgtgcagggctgggaggaaaagtgactttggcggagcgattcacaattatctcctggtcacctcagaagtccagggaaccttagggcatactgtatggatcagtaggaacagctgggtggcagagccagcaatggcagtgacccctggccccttacactctgcagagaatatggccctacccttccatgaaggtggcacaagaaggcttaggggagcccttacgggagcaggggtatgaagggcgctcatttagtcattagttagttactgacctaccgtgtgcccagcaccatccttgcgacaggggaagcagcagtgagcaaaacagaggcccttcctccaggacctccacactctgggagacaggaacctaagacccaggcctagaagagg

SEQ ID NO: 379596 - DNA, 384 bp, Homo sapiens
accactgcctcccgggtttaagtgattgttctgcctcagcctcccgagtagctgggatcacaggtgcacgccaccacacccggctgatttttgtatttttagtagagatggggtttcaccatgttggccaggctggccttgaactcttgacctcaggtgatccacctgcctcggcctcccaaagtgctgggattacatgcttaatttgtttgttttttcactttagcagtacattctggaaatctttctatgtctgtatttttcatcacatggacatagcataatttaactagtacacgattgatttctcaatattactttaagagtgacttaatggagtcaatgctaacttcattcatgattatgcaatatattatggacctt

SEQ ID NO: 379597 - DNA, 403 bp, Homo sapiens
cacttaggccagctaccatttcacatcgctaacaccccctcgaatctgttaacactttttttttttcctaaaaactttcttagtggatgtggaaaaaaaagggagggcggaggggcctgggggataaaggctactgtcaaattgattaagtgaacgctcattagagaaagtaacaagaggcaaaatctgcatatgcattgcagaaatgtgtctgatcttgcttaagttgtaaaagacaaaaagggctgaaaacctccctcgctggaagtacttgagggagaactgggggaggggaaagttctctaacagtaactttctttcattgtaaacacaagctagagcagccacagactccaacactctggtacaaactttgttttctaataatttgtagtacgattat

SEQ ID NO: 379598 - DNA, 405 bp, Homo sapiens
gtgagatgtgcctttcaccctctgccataattgtgaagccttcccagccatgtggaaccataagtctattaaaattctttcttttgtaaattgcccagtcttgggtatgtctttataagcagcatgagaatggactgatgcagagtggtattagaacttaaaaaaaaaaaaaagctatttgaaattaccttgagtttcctctgggtggtccttcaatataccatgacttgtgtgagtttctgtgagcttggatttagcaaactcagtggctctttgtctctactctcagctcccaccaccacagtaacagttggtctcctgagggtcgcagttcagtttcaaatataatcccatccatgtcactgttgaaagggtccctttacagattacttcttcctttcacag

SEQ ID NO: 379599 - DNA, 951 bp, Homo sapiens
agccctcagtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtaaaaaagccacgggtgccgtttaccctctggcacacctctggccacccccacccccttcccttaccctcatccccagagacatcctcagcttccagctccctcctgtccatagccagctttcccaggtctgggcatgggggacaaaggctgactctgcctcctgtctttgtcgttgagactttttgatctagaaaagggagagcccttttctcaatgaaaattcaaataccccaattttggagtccccatcccattctctagcctcacctatctggccggtttggtacctaaatgaaggaaccagctaagggtcagattgtttttcttccatctcttaaggtagcttattttttgtaaattttatttattatttatttatttatttatttatttattttagatggagcctgggcaacaagagcgaaactccgtctc

SEQ ID NO: 379600 - DNA, 1210 bp, Homo sapiens
agccctcagtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggccccagtgtgtatcattccctgtctaacaccgtacgtattctaagaccactcctttgctgatgacaaatctaagtgatggttcgcaggggactctcttccctgcttctgtctggagagcctgcctggcttcaggttcctgataggagtgaggacctggagtgcagtgtgagaaacagatggctcagtgaagaactgtcatcatccactagagtccctggaaacagccgtgtcatttagatgatgtgggtttgtgtgcatgagggttgggagatagccaggggtgaattaatgtgtagtgtttgtaaatgtgtgttttcccccaaaaatgtggacccgcatgcccagcacaagtgcaagtgtcagttttcttgaattcctggcctatggtggtcctctcacctcagcctcccaagtcatgtcattcttctaataaaaaggaagaaaaacttcagcaccaccatacactttacataaatgacctctttttcactcaacacagtgtacctgaaggtcagtttaatatccctacttcttagagagagagagagtgtggaaaggaatgaacccagattttgacctcctgaatggaagaggcaaaagtgaacccagaaatgggtcccgatgttgatggtctgcattactcaaccgtgtcatcactccaccgtgatatatgaccccacaccagggagttccag

SEQ ID NO: 379601 - DNA, 806 bp, Homo sapiens
agccctcagtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagatctttcctctgtgtccttccaggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgtcttctgaggacaactgagttagtatgcctaccacgaagtgaagatgatgactgtgatgatga

SEQ ID NO: 379602 - DNA, 2815 bp, Homo sapiens
  misc_feature (16)..(16): n is a, c, g, or t
ctctgggcacagatcncaccagtctgctcaccagtctgctcagtcaaagcagagtgggtgcgctggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggcaacttggtaggaggtagggaggggctggaagatcggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggagcagagcggagaatgcccatggccctttattccttcttccctcggtccacgaacaggaagaggctgaggccatgctgggcagggtctggatgcccactttccatgcagcagcatttcattgctcaaaaccatccttcctttcccttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttccta

SEQ ID NO: 379603 - DNA, 2983 bp, Homo sapiens
taaatcagctttctcagattgaaatatatatttttaaataactgcaacttttgagaatgagctgaacacttcacagtgaaaattgaactaattggttaaatatccagagtctgtatctctattggaatgccttctaaagccccaagacaccaggaactaagcaaaaaggagctcaatgcaggtcctgtgatgaatctgaaaagctaaagacatactgtggttatgatcccctgggaagcagaagggtagggcctctctaagaggcctgcaggtctcctgggtgatgggtggttttttccattgtcccaaggatggaaggaattctgtttcccactagagatgtggctcttttcctcattcctgaaatccaagggctcattttttgtccatgtttcctcagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggcaacttggtaggaggtagggaggggctggaagatcggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggagcagagcggagaatgcccatggccctttattccttcttccctcggtccacgaacaggaagaggctgaggccatgctgggcagggtctggatgcccactttccatgcagcagcatttcattgctcaaaaccatccttcctttcccttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttccta

SEQ ID NO: 379604 - DNA, 1511 bp, Homo sapiens
  misc_feature (16)..(16): n is a, c, g, or t
  misc_feature (1451)..(1451): n is a, c, g, or t
ctctgggcacagatcncaccagtctgctcaccagtctgctcagtcaaagcagagtgggtgcgctggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctctctccatccgggagtggagagagaaggaacaaagaaatctacaaactggttgtgatcaattagttgtaaataccactgcacttggatcagccaggaacaagttctttgaaatacgccagagaattaacattatcagtgggccaaatgtgtggaagatgtattatcctagtctcttttcctgttctctagaagtatgttactggttcttaaaagatttcacaaaaatacgctttgaggagaatcaagntttcttgatagtatctacaggcacttaatgcacatttcagggaggaagtgatgggagaga

SEQ ID NO: 379605 - DNA, 970 bp, Homo sapiens
taaatcagctttctcagattgaaatatatatttttaaataactgcaacttttgagaatgagctgaacacttcacagtgaaaattgaactaattggttaaatatccagagtctgtatctctattggaatgccttctaaagccccaagacaccaggaactaagcaaaaaggagctcaatgcaggtcctgtgatgaatctgaaaagctaaagacatactgtggttatgatcccctgggaagcagaagggtagggcctctctaagaggcctgcaggtctcctgggtgatgggtggttttttccattgtcccaaggatggaaggaattctgtttcccactagagatgtggctcttttcctcattcctgaaatccaagggctcattttttgtccatgtttcctcagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggagaggtgggtggaagagaggtggcagtggatgatgtctctgtcatagtggtgggataggtgatgtccgtcgtggagtttgtaccaggaccagtcggagaattaggataggtggtctcagatgtagtcatagatgaagcatttggagtggggagtgtggtcaccaagatagatggagggattgtggttatggtgccactggtgactacttctgtgcttgggacaggtgtagaagacagaggcattctggtcagtgatgttaatcaattggtggttgtgggaggagaggtcgtagttgtcatagaagtcactgtatttgtggaagtgactgatgcacgtgatgtggaggagac

SEQ ID NO: 379606 - DNA, 3218 bp, Homo sapiens
  misc_feature (16)..(16): n is a, c, g, or t
ctctgggcacagatcncaccagtctgctcaccagtctgctcagtcaaagcagagtgggtgcgctggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggcaacttggtaggaggtagggaggggctggaagatcggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggagcagagcggagaatgcccatggccctttattccttcttccctcggtccacgaacaggaagaggctgaggccatgctgggcagggtctggatgcccactttccatgcagcagcatttcattgctcaaaaccatccttcctttcccttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttccta

SEQ ID NO: 379607 - DNA, 1170 bp, Homo sapiens
  misc_feature (16)..(16): n is a, c, g, or t
ctctgggcacagatcncaccagtctgctcaccagtctgctcagtcaaagcagagtgggtgcgctggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttccta

SEQ ID NO: 379608 - DNA, 1043 bp, Homo sapiens
  misc_feature (16)..(16): n is a, c, g, or t
ctctgggcacagatcncaccagtctgctcaccagtctgctcagtcaaagcagagtgggtgcgctggggtggacgtgtcagccctgagcacccggcctccaggctgcaggaatatgagccagtgtcttcactttgctcgtgcctcagttttacaattgtaaaatagggcactacctagaatactgggtacattttgtgtgtgagtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttccta

SEQ ID NO: 379609 - DNA, 1089 bp, Homo sapiens
  misc_feature (48)..(48): n is a, c, g, or t
  misc_feature (96)..(96): n is a, c, g, or t
  misc_feature (119)..(119): n is a, c, g, or t
agatgtgtagctactttttcctatttgaagccatttcgtagagaaatnccttcactataatcaaataagtttgtcccatcaatcccaaagatgttnccagtggtgctcttgaagaggantgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcacccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 379610 - DNA, 4836 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcataaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379611 - DNA, 2770 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcataaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggaccactgcactccagcactccagcctgggtgacagagcaagactctctctcaaaaaaaaa

SEQ ID NO: 379612 - DNA, 302 bp, Homo sapiens
ctattctgctgagagatcaaaaaaaatgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctgccactgcactccagcactccagcctgggtgacagagcaagactctctctc

SEQ ID NO: 379613 - DNA, 3618 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379614 - DNA, 4371 bp, Homo sapiens
gcatcctgtacgcagcttgcagttttccagttttctctttgtgggcgttatttccataagagtgcagacttctgggatgcaggtcagggctgtgacttccctgggtttctctggagtgagatcagtgtggagtggagaggtgtgtgctggaggaagaggccttggcctgtgctccgcattgcctactcctctcacctggaaacaccggacttcaggagtcactcggctgtggcagaaaataaagttcttgaaaggaaagcagaggcgctcactcacatcgatgccctaaacatcaataccacatcaatgtcccaagtggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcataaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379615 - DNA, 4123 bp, Homo sapiens
gtctacaggagactggtagcctcgagaggaaaaataagcataacaaatcactcctgccttcggggtcgaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcataaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379616 - DNA, 2049 bp, Homo sapiens
ggaccaaagttcccacctgtcaaaaaatggaattaggggtggcttgttacaggccccaagaatgcccatccttttggcagaccaaggtagtgtggttggcctcagagacaggtcccactctaagagtgataaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379617 - DNA, 747 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccaggtgagcgctcaggtagcccgggtgagggccgggaacccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagaatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggaccactgcactccagcactccagcctgggtgacagagcaagactctctctc

SEQ ID NO: 379618 - DNA, 3877 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379619 - DNA, 4876 bp, Homo sapiens
ggcggtgtttgaggccggccagtcgtgactgggcggcaatgaggtcagtgactgccgggagtcctgcaggggcggggcggcgccaagcgcagggagcccggctgagtggcagcccaggtgagcgctcaggtagcccgggtgagggccgggaacccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcataaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgttgctcgacgttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgtatgcctgtggtcccagctacttgggaggctaaggtagaagaattgcttgaacctgggaggcagagattgcagtgagccgagccactgcactccagcactccagcctgggtgacagagcaagactctctctcaaaaaaaaa

SEQ ID NO: 379620 - DNA, 321 bp, Homo sapiens
aagtagctgggattacaggtgcatgcctggctaatttttgtatttttattagtagagacagggtttcaccacgttggccaggctggtgttgaactcccaacctcaggttatctgcccacctcggcctcccaaagtgctgggattacaggcatgagccactgtgcccagccgtcatgaactttttaaagattacaaagtgggccaggtgcagtggcccaatcctgtaatccccagcactttgggaggccaaggctgatggatcacttgagctcaaaagtttgagaccagcctggacgacatggcaagaccccatctctacag

SEQ ID NO: 379621 - DNA, 358 bp, Homo sapiens
gttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcct

SEQ ID NO: 379622 - DNA, 2347 bp, Homo sapiens
  misc_feature (1188)..(1188): n is a, c, g, or t
ctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttngatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 379623 - DNA, 351 bp, Homo sapiens
tttatctgttttaatgcacagaaatcacttagctttgtactgttcatataccacatgtcccactattaagagtctggtatacacgggcatcctgacattgttcactaccctttaatgtacttttggcataaacctgtcacagctatttagattgttaaacacctgcagcagcatacatttatcagccagaaataaatctggacaccttagcatctatttaaccgttagcccaacactacaataatcccaaatcccctctatcacacttgcctttttcttaatcctgtgtcatcaagacttaaaaatagatcattttatcctatctactctatataatcttcaaagatttaa

SEQ ID NO: 379624 - DNA, 251 bp, Homo sapiens
gggtgggattgcaagggctgatggatttacagattttcttacctgtataagaaaaattttatgaattttgtggagtttgtgagttctagaatggttttagagatatacattttgattattttaaagcatcaactcaaaactaggaggctgggcacaatagcccatgcctgtaatctcagcattttgggggctgaggtggggggattgcttgagaccagcctgagtaacgtagtgagaccccatctctacaa

SEQ ID NO: 379625 - DNA, 632 bp, Homo sapiens
ttccttcttcttttattcttaattttgattcattttgggagtgtggtgattaatttttttccagaaagggcaaatgagcagtacattgtatatcacagaatgcctgttacctttacaatttggatgagtagagaaatcttgggctacaaaactacagacattgctccattccagatggcatttaaaatgtgtagaagaggatcttcagtcttgtgacttttaaaattttttagatcaaccatgtttcttctattaaaacgagttattgtttattgggaacatctattagtcaaaggataaatctctgtaatcagcctttttgatctgcaccttttctcttactatatttgtcggagggtgctttttatcttttgctctggtgctttttgttcatcctaacttatttaagctgcagagaatcctttaaaagaaagcttttaaagcacaatatataacattgatgaaagcagttctgatctggataatgaacaaaaagtgggggaacttccctccatcttcgctttgtggactcatgagaacccacaggattctgaaaagtagttcagtattcactgttcatcatggattcaattttctttagtgctatgactatttactatttctgactcaaa

SEQ ID NO: 379626 - DNA, 418 bp, Homo sapiens
attcatccccacagctatacaacagcagatcttcactgtgtacctcctctgtgcacagctttgtgtttggagggaaggcaccctagggttatgggcaaagtagctcttacatgatgggccaattgctttcctggattcttatttattcctcacattaacctcacatgttattatttttccattttacaggtgaggacatgggggcacagaggaccttgaggacaaggttgtttgtccaaggtcatgtgaaaagtaagtagtggaaccacggttcaccctaggtcagtggttcttaaatgagggaactttgcaccctgcacccccacagatatttggcaatgtctggagacatttttggttgtcacaactgggtgtcaggtgctcctgccgtcttctgggtagaggccaaagatgttgc

SEQ ID NO: 379627 - DNA, 1805 bp, Homo sapiens
gtagctgggattacaggcgcctaccacatgcccggctaatttttgtatttttggtagagacggggtttcaccatgttgttcaggctggtcttgaactactgacctcatgatttacccgccttggcctcccaaagtgctgggattacaggcgtgagcacatgcacccggccacatttggacttattaacacatatgaagtgcttggtattttagagtgcttccacacacacaatcctcattagagatagacaggatggggagaattaataagccattgcccgtgttacagtgaggaagcagaaagatgagaagtttgaactttggtcagcctggctttctcataacccattttgctgactaaattgcgagtatccctcctttggtatatttattggtgagaagtcacagcccttgtcccacaggttttgcagccaatcaggagaaagaaattaggcacctgtaaagtattactgaatcatagatagttcaccagtggtttgggcagttggcaaattaatttagggacatctgttctgaaacagcattgaaataggactgactgctttgctttctggttgtggcagccagagccaaaggcagatgaatgaggggctatgaggaggctactgtggctggaacagtatgaaagcaacctcagctcccacgcctggctgtaaaggggataataactgggtgctgcttcccagcctctttcatctgagaagttcaaagcacctcacccctattaacaccccacagagtaggtaggaagtaccaatagagcaagccaggaaaactgaggccaggaggcacagcctggggctagctgtgaatcacctgtggggcctagagcccaggaatcctgacgcccaggctactggacaaatcctttatcagggcattagggtgggtgctatgcttttgaaagcagtaccaacggctgtggtcgtgggttttgatgcttgccactcacagaggccccagctctcaccataacaaaccaaatgggggctggaaggcatcctttacaactttatggtctcgtatgcaagcaccctcagcattctctgcacccatggagtggagatgggtgggagtaatccaaggcctttattttcaggccatggtttgacagcaagggtattttcttccccaataaacgtagcttctgtctaccttccactggcagcaaaatgattttctgttctctgcatatactgaggggatctgcacagtgcagaaaggaagatgtccgagatccaagtgaggcctgttcagtgtgaaatgtctagggtagaagaaagaccatcctccattatggctggcatgtggcagtcatccttaagattatttttaaatttcctaataaatataggaaagtaaaaaacttagaaaatgaaagagaaggccgagcacggtggctcacgcctgtaatcccagcactttgggaggccaaggcgggctgatcacctgaggtcaggagtgtaagacaagcctgaccaacatggtgaaaacctgtctctgctaaaaatacaaaaaaatgagcagggcatggtggcatgcgcctgtaattccagctacttaggagactgaggcaggagaatcgcttgaacctgggaggcggaagtttcagtgagcggagatcgcgccattgcactccagcctgggtaacaagatggaaagtacatctcaaaaaaaaaaaaaacgaaaatgagtcacccagaatcccataacggaaactttctatggggtcatctgtttaagagaaaaataaattctatattcaaatgtatattttgtgtatt

SEQ ID NO: 379628 - DNA, 320 bp, Homo sapiens
ctatgagagtgtggcaaaaatcaagagggcttggaagttttttctttgctcttgcaactggctggatgcagttcatatatttttcaaccagtaggtggcaccccaacctaattttttgcagttgtaacctgggaggcggaagtttcagtgagcggagatcgcgccattgcactccagcctgggtaacaagatggaaagtacatctcaaaaaaaaaaaaaacgaaaatgagtcacccagaatcccataacggaaactttctatggggtcatctgtttaagagaaaaataaattctatattcaaatgtatattttgtgtatt

SEQ ID NO: 379629 - DNA, 359 bp, Homo sapiens
gagcttatcccaggaatgttaaattgttttttaaacaggaaaattggtaaatgtaatataccatataaatacaataaaggataaaattacatgggtatctcaatagatgtgaaagcatttgacaaagtccagcatctacacataattaaaactcatcaaactagaaagagaaaggattttcctcaatctgataaaggccatctactaaaaacccactgctaacatgatatttaatcgtaaaaaattaaatgattttcactagaattgtgatatttgctctcatcatctctctcccatcttgcattggaggttctagcatgggcaattgagtaagaaaatgaaataaatcaaaacataca

SEQ ID NO: 379630 - DNA, 392 bp, Homo sapiens
tcctggccaacatggtgaaaccgcttctctactaaaaatacactgggcgtggtggtgcacacctgtagtcccagctactcaggcaggaggatagcttgaacccgggagacagaggttgcagtgagccaagattgcatgccactgcacttcagcctggggacagagggagactgtgccttaaaaaaaaaaaaaaagaaagaaagaaaagaaaaaagaaaaaaaaacctagactgctggtgtgcaggtgtggggatggagggaggtgggcatgagggcaatgataacattcccttagaagtttgagtctgggtgtggtggctcacgcctgtaatcccagcactttgggaggccaaggtgggcggatcacctgaggtcaggagttcaagaccagt

SEQ ID NO: 379631 - DNA, 364 bp, Homo sapiens
ttttataaaatacccaaattgcaatctggacttggagtctcccatgtgggatctgcagcattcctagggctgctgtttgtttgatccctgggttttgtcagatggatgctttatcaggtcttctatgttgccctggctgttgctttccattccggctttaaattctcatactttgctcccctcatcaagcaaacctttactttctccatggcctcatcccaagggctccctgacatttcacgcaccagcttttgtttttgtttttgcatacgctcttggaatctttgggccaaatgggaaaaagaagttcatatgatctaccatataaatatgttcattagatgatgagtcttactatccagaa

SEQ ID NO: 379632 - DNA, 396 bp, Homo sapiens
ttgttgaatttggttttcgtcaatatttatcagagatattggcctgtggttttattttcttacaatatgtttgtctggctttaggtatcacggtgatgctggcctcacaaaatgtgtttggaagtattccctgtagctctaatttttggaagagtctaagaagtgttggtaataattattctttgaatgtttgataaaattcagccatgaagccatttggtcctaggcttttctattttggaaagtttttaatcacttcttcaatttctttatttgttgttggagtgttcaaactttttgtttcttcccaattcaatcttgatgggttagtttttctagaaatttatccaattcttctaggtcctccaatttgttggcataaaattgttcataata

SEQ ID NO: 379633 - DNA, 2767 bp, Homo sapiens
gcaggctggtaccggtccggagtatggattctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcccagcactttgggaagcccaggcaggcagatcacttgaggtcaggagttcaagaccagcctggccaacctggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctcaaaaaaaaaa

SEQ ID NO: 379634 - DNA, 617 bp, Homo sapiens
ggcgcccttcagcggacacctgggacttgcagtgttatgtgcccagggattttcctggacgggattgtgaagtagcgggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379635 - DNA, 2773 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcccagcactttgggaagcccaggcaggcagatcacttgaggtcaggagttcaagaccagcctggccaacctggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctcaaaaaaaaaa

SEQ ID NO: 379636 - DNA, 2670 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaactggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctcaaaaaaaaaa

SEQ ID NO: 379637 - DNA, 4016 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379638 - DNA, 2702 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379639 - DNA, 2825 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtggaggagataatgcctgttgtgtacagcaagacagtgggtcattgtgtatttacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379640 - DNA, 2631 bp, Homo sapiens
tgagagatgaagtctttctctgtttcctaaactggagtgtagtgagtggcatgatcatcattgactacggccttgaactcatggcctcaagtggtcctcctgcctcagcctcccaagtcactgggattgtaggcatgagccaccacacctggcgaaaatacggtctgttaaaataatttaaggaattctttctcccgctgagataaagaggggtattttaaaaatagctttaaaacctgtaaaacatggacactgaccccttatttccatccacagaaagaaagactgagagtaaatgggcttaaattgttgcaagagagtttattcatctttgaagagaagattattgatactgcagtaggccaccaagaacaagagggtgctctgtgggaccagcctgggtgggcagcagcctgttttattcatctttgaagaaaagattattgatactgcagtaggccaccaagaacaagagggtgctctgtgggaccagcctgggtgggcagaagggtagaaggaaaaggggaggagtctcccaggtgctcacaccacatcctcctcccgtgtcccagatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379641 - DNA, 3218 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacggtgagcctgccccggccgctgtgccacgaggctccccgggcgcgctcggccagggccggcctccctaaccgcctccctaccgccctctttaactcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtggaggagataatgcctgttgtgtacagcaagacagtgggtcattgtgtatttacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacaaagaaagactgagagtaaatgggcttaaattgttgcaagagagtttattcatctttgaagagaagattattgatactgcagtaggccaccaagaacaagagggtgctctgtgggaccagcctgggtgggcagcagcctgttttattcatctttgaagaaaagattattgatactgcagtaggccaccaagaacaagagggtgctctgtgggaccagcctgggtgggcagaagggtagaaggaaaaggggaggagtctcccaggtgctcacaccacatcctcctcccgtgtcccagatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379642 - DNA, 2590 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtgggggagataatgcctctttcttttgtgtacagcaggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacgtgagtcagtccgctgggaggctgtcctctcccttgtgtctttttagtagaccagagtccttcttctgatttctagaagacccgcactctagcgggccctcttccccatgtagtttgggatttaacttaggccaatggaatggttttcactagtcatattaactgacatgggctattaatagctcagaaggttctaggcagtgtttcctgcatggctacgctaggtatgtgagggcctcttaggtttcagccaagacaggtgactcttagcacccagagcccttcagatctgatggcggttggtattgttggtccttctaatgatttcagaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379643 - DNA, 2959 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcatttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379644 - DNA, 1277 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtggaggagataatgcctgttgtgtacagcaagacagtgggtcattgtgtatttacagaagtgatgtggattcctcccagactcattagtgacctgaggctgcagcagaagcagccgctgagctgtggtggcctagatgcccgatacaacatatccgtgatcaacgggaccagcccctttgcctatgactacgacctcacccatattgttgctgcctaccaggagaggaacggtgagtcacaggtagagcccattcagccgctgctcaggactttcaaggtcgactaatggaaaatgaaaccaacaccatagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379645 - DNA, 1223 bp, Homo sapiens
ctcacccctgtaatcttagcactttgggaggccaaggcaggaggatcccttaaccacaggagttcaagaccagcctaggcaacatagggagaacctctttaaaaaaaaattttttttttaatttaaaaaaaaaaagatcaaatgagacaaatgctattcacatgtttcttgtcttgttatcgccacttcaagttcccatttattttgtccagtgaacatttgaaagactcagatatgaagttcaggggccatgcactttgtgcctctttccccagtattaatgcacttacacctgtctatttttctctttcttttagtgggggagataatgcctctttcttttgtgtacagcaggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacgtgagtcagtccgctgggaggctgtcctctcccttgtgtctttttagtagaccagagtccttcttctgatttctagaagacccgcactctagcgggccctcttccccatgtagtttgggatttaacttaggccaatggaatggttttcactagtcatattaactgacatgggctattaatagctcagaaggttctaggcagtgtttcctgcatggctacgctaggtatgtgagggcctcttaggtttcagccaagacaggtgactcttagcacccagagcccttcagatctgatggcggttggtattgttggtccttctaatgatttcagaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379646 - DNA, 530 bp, Homo sapiens
gcaggctggtaccggtccggagtatggattctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggtaccttctccaccaactccagttggcagccaccctgaaagaggatagcatctttgtcccaggaactcaaaaaggagtgtggaaacttagacgagacctcatttttgtgtttttctccagccatacaccctcctgggcaataagagtgaaactccgtctc

SEQ ID NO: 379647 - DNA, 335 bp, Homo sapiens
ttttatatgcctaaatttttttcttaagatttatttatttttatagatggggttttcactatgttgcccaggctggtcttgaactcccaacctcaggaaatcctcctgtctcagccccacaaagtgccaggaatataggcatgggccagtgtgccccgtctcttgagctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379648 - DNA, 893 bp, Homo sapiens
ctcacccctgtaatcttagcactttgggaggccaaggcaggaggatcccttaaccacaggagttcaagaccagcctaggcaacatagggagaacctctttaaaaaaaaattttttttttaatttaaaaaaaaaaagatcaaatgagacaaatgctattcacatgtttcttgtcttgttatcgccacttcaagttcccatttattttgtccagtgaacatttgaaagactcagatatgaagttcaggggccatgcactttgtgcctctttccccagtattaatgcacttacacctgtctatttttctctttcttttagtgggggagataatgcctctttcttttgtgtacagcaggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379649 - DNA, 844 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacggtgagtcacaggtagagcccattcagccgctgctcaggactttcaaggtcgactaatggaaaatgaaaccaacaccaacactgcagagaagcaaacaaaagagaaggcattttaactgg

SEQ ID NO: 379650 - DNA, 2638 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcctagctactcgggaggctgaggcaggagaattgcttgaacccaggaggcggaggtagtggtgagcaaagatcgtaccgctgcactccagcctgggtgatagagcaagaccctatctcaaaaaaaaaa

SEQ ID NO: 379651 - DNA, 2825 bp, Homo sapiens
gcaggctggtaccggtccggagtatggattctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggaaccagaccctctccagcttccatatgtcttcacctggtgtcctatctttgccgcaggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcccagcactttgggaagcccaggcaggcagatcacttgaggtcaggagttcaagaccagcctggccaacctggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctcaaaaaaaaaa

SEQ ID NO: 379652 - DNA, 4361 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgccgaaaaaaaaaacaaaaagacaaagacagaaggagcagacgacacagaccaagacgacacggaaagggcgagagcgagagcaccacaacgacaagtacagggcgggaagaacaaacagcccagagaaggcagcaagagcaaaccagcaagcgaggagcgaagaagacgagacgaaacagggacacggagaagggagggaaacacaaccgtaagcaggagaagcgagacaaaaagagaggaaagcggcagaaagaagaaaggaacggcagacaagaaacagaacgaaccgcacagccgaagacaagatacaggagcaatctgacgaggagagaggaagaggcggt

SEQ ID NO: 379653 - DNA, 2723 bp, Homo sapiens
agcggggctgtgacatcatatccagctctcatggccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379654 - DNA, 3142 bp, Homo sapiens
cacgcgtccgtcgaggcacgcgtccggacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcaggggactagtttgtggaaaggtctgagagttcctggaggctataattagctttttggggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaaggggcaagggccgcattagcacaggcaatcagggagggccgctgaaggacacttggaccgtccacctgccccagcccaacagtcagtcatctgtcatcagctcagctgagcagccctggatctttgccgtactgtgactggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatg

SEQ ID NO: 379655 - DNA, 2260 bp, Homo sapiens
acgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtgggggagataatgcctctttcttttgtgtacagcaggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379656 - DNA, 1373 bp, Homo sapiens
tggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacggtgagcctgccccggccgctgtgccacgaggctccccgggcgcgctcggccagggccggcctccctaaccgcctccctaccgccctctttaactcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtgggggagataatgcctctttcttttgtgtacagcaggacagtggggtcattgtgtatgtacagaagtgatgtggattcctccccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacgtgagtcagtccgctgggaggctgtcctctcccttgtgtctttttagtagaccagagtccttcttctgatttctagaagacccgcactctagcgggccctcttccccatgtagtttgggatttaacttaggccaatggaatggttttcactagtcatattaactgacatgggctattaatagctcagaaggttctaggcagtgtttcctgcatggctacgctaggtatgtgagggcctcttaggtttcagccaagacaggtgactcttagcacccagagcccttcagatctgatggcggttggtattgttggtccttctaatgatttcagaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaatgtaagggcgcttctcattgtccagctcctttgtttctgtgtgttactgttcgtcgagttctttgaagagggggataaaaagtagaaatatttctctgtgggtggctttcaagggaccttctgaggaattcttgccatgaagtcttttcagactatgaagatacacctgtatt

SEQ ID NO: 379657 - DNA, 252 bp, Homo sapiens
tagacatgtgaatccaattcatcaagggcttctttccaaaaaatcatgaaaccaggaaatgatattttctttctgtgtactttcctccttcctttcactgctgtaagaatgaggaagcgagttgtagctcagaacaaaaccacaaaaacctttccatagatccagctcaaatcagggaaatcagcatctcacttttgctgcctgtccctcctgtagaaaaccctgagaattttgtttgttttgtttctttct

SEQ ID NO: 379658 - DNA, 553 bp, Homo sapiens
gctttcctggtttccctcctttctctcttaattttcatttccttgtttggcttcttctcaacctgtatgttaaatgttggcgtcctcaaggtagacccagccccacttcgtcctctgcactctctcccttggtggtctccaacagcccatgcctttaactaccacctatacaccaacctaacgtccatctctctgacctccagatctgcttagcagtatctcacagtgacctcagcatcaagatgtcccaaatccacccctgaccacctctgcagatctgacaacagcatccttctttcggctgcagacaaagccagcatcctagaaatagcctgtgactagcctccctctcacatctcctcaatgaacaagtcctcaaaatgccagcttttattgattgattgattgatttattcattcattgagacagagtctcactgtgtcacccaggctgaagtgcagtggcacgatctcagctcaccgtaacctctacctcctgggttcaagcaattctcgtgcctcagcctcctgaatagctgggattacaggcgac

SEQ ID NO: 379659 - DNA, 403 bp, Homo sapiens
cctattctcaggaacgttctggccttcctaacagtcatatccccaaagctgttcttaagacaatgtaggcttttcattgcatccttctttctttttgaagaccatgtagacattcagcctgcattttttctttttaaaagcacactgctcacatcttttggagttcttcccctaagatgggctgcagagtaggttagcttaatttttctactgcataggataaacacatatattcttttgatttaagagttttattgttagccaagcatggtggcacgggcctgtaatccccattactctataggctaaggcacaggcatcccttgatcctggaaggcggaggttgcagtgagcttagatggcaccactgcactctagtcagagaaacagagtgagactgtct

SEQ ID NO: 379660 - DNA, 2114 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 379661 - DNA, 2104 bp, Homo sapiens
  misc_feature (2095)..(2095): n is a, c, g, or t
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaaacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattnttccatttc

SEQ ID NO: 379662 - DNA, 2434 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctcaaaaaaaaaaaaacctacaaaatcttttaatagctaataaatcacaatacacaatactcgcgcaattgtactatatcttaccttaaccctttaaatcctccttcaaatttactcctttgctcaaacaaaaacagctctggggggcccccgttcccaatttgtccttatagtaatcctttaccactcactggtcctctatttaaagcttggagttaggaaaactctgggctccccaactttatctttctaagcaatctcccttttcgacttgggctttaataaaaaaacccccaccttatgcctttccaacgttcgacatc

SEQ ID NO: 379663 - DNA, 2197 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcaggtgactcccgagggttggggatgagtgaggaaagcccgagcccagggaggtcctggccagcctctaactccagcccccttcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 379664 - DNA, 929 bp, Homo sapiens
gcgaattcaatagtgattgtagagctgagatcgcaccacacggtccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 379665 - DNA, 2142 bp, Homo sapiens
  misc_feature (2133)..(2133): n is a, c, g, or t
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattnttccatttc

SEQ ID NO: 379666 - DNA, 2299 bp, Homo sapiens
  misc_feature (2129)..(2130): n is a, c, g, or t
  misc_feature (2132)..(2132): n is a, c, g, or t
  misc_feature (2143)..(2143): n is a, c, g, or t
  misc_feature (2160)..(2160): n is a, c, g, or t
  misc_feature (2227)..(2227): n is a, c, g, or t
  misc_feature (2240)..(2241): n is a, c, g, or t
  misc_feature (2254)..(2254): n is a, c, g, or t
  misc_feature (2256)..(2256): n is a, c, g, or t
  misc_feature (2275)..(2275): n is a, c, g, or t
  misc_feature (2285)..(2285): n is a, c, g, or t
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctcaaaaaaaaaaaaaannanctctcccaccncccacacatccatcccnccatacccacacataccttttcaactctttcaccttctctctactatcacaaaaataaaaaaacctngggggggccccgnnccaaattcccctntnggggcggtttaaaatactnggcccctttnaaactcgtgcctgg

SEQ ID NO: 379667 - DNA, 2306 bp, Homo sapiens
  misc_feature (2130)..(2130): n is a, c, g, or t
  misc_feature (2146)..(2146): n is a, c, g, or t
  misc_feature (2150)..(2150): n is a, c, g, or t
  misc_feature (2162)..(2162): n is a, c, g, or t
  misc_feature (2198)..(2198): n is a, c, g, or t
  misc_feature (2234)..(2234): n is a, c, g, or t
  misc_feature (2247)..(2248): n is a, c, g, or t
  misc_feature (2261)..(2261): n is a, c, g, or t
  misc_feature (2263)..(2263): n is a, c, g, or t
  misc_feature (2282)..(2282): n is a, c, g, or t
  misc_feature (2292)..(2292): n is a, c, g, or t
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctcaaaaaaaaaaaccacncccccaccccacccancacnaccccccaaccncaccacccacccaccaaccccccacacccacccccncaccaccacccccaaccacccaaaacaaaaaacctngggggggccccgnnccaaattcccctntnggggcggtttaaaatactnggcccctttnaaactcgtgcctgg

SEQ ID NO: 379668 - DNA, 2059 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcactcaaccaacctccccgcagagctcccttcctgaccctccgctgcagaggattgaggcttaattctgagctggccctttccagccaataaatcaactccagctccctc

SEQ ID NO: 379669 - DNA, 2059 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggacccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 379670 - DNA, 762 bp, Homo sapiens
ggaacagcagttgcccagataagccaaggcttagaaacgagcctctgaatgcagttgctaattcacgagcttcaggtcgtcactttaagggccttttctaccttgttgggaagaaacaagccctagaagtcctgagtgaaaagcagcatggtgagaacattccagtgcacagcaagggcctcgaatccaggccggtgaagagatcacgcatgggcagcagagccgcacgtgccgctcaggtgacccgttgctagtgggtcctggcaaccacacacggggctgttatgctttggtcaccatggaaattcccgggaggtgccaagtgtctgggctttgttttccaacagctgaaagacgatgcagttgccctggtagacgtgatcgctcctcctgactttgttctggactcaccgattggcagagccgacggcgaggtaaagggaggacagggcctcacgggagtgccccaagggttgatgggcatttctgcggagctgagatgctcctgtgggtcaggggtctggtgtcttctggaaagtggtcacacatggaggagcttcttggggagggcccgggacaagtcaggactgtctcactctggtgcttccccatgctggctctgtggttgcaggggacttgcccatcccctgcctgccttttcctcccgagatggggtggtggcactgcccgcctgcacaggcagaggttggaggtccacacactgtgacctctgccctcctgcatcagccttttaggcgacgg

SEQ ID NO: 379671 - DNA, 2921 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379672 - DNA, 2973 bp, Homo sapiens
atgggacggacggaggccgagaggcgtggcgggggagcagtggggccaggccagagacagctgcgctgtgcgggcagctagtcccagtactccgagtcggtcgcgggccgacaggcatcccctgagcgcctgctgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379673 - DNA, 2968 bp, Homo sapiens
  misc_feature (15)..(15): n is a, c, g, or t
tctggaaaacaaatnaaaaaaaaaaaaccaaaaagtggggccaggccagagacagctgcgctgtgcgggcagctagtcccagtactccgagtcggtcgcgggccgacaggcatcccctgagcgcctgctgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379674 - DNA, 2283 bp, Homo sapiens
  misc_feature (82)..(82): n is a, c, g, or t
cagcgctgtgtggccttgggcaagtcacttctctgagtctgtttcctcatctttaaaatggggatgataccacccatgttgngggtgttatgagaactgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379675 - DNA, 1651 bp, Homo sapiens
cagcaccacgcttcacacagaccgagcctggtgcgtgcgagaacgtgcagccgtcccactcgggggcccactctagcggcggcaccgtgttcctgtggcctccaggctgctggaacagtgtagaactcaggacagccctgggctgagccaggaagtgcctccagccaggggggccctgggcaggtgccctccctgtgcttcagtttccctacctataaaatcagacccaccccatacacttggttgtcaatgaagacaacctggtacctgcaggatgctggcagtgccttgtccctgggggtgagttgtgacaaatgctgtgttctctattgttactttttctccttctgtttgtcattccgaagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379676 - DNA, 1483 bp, Homo sapiens
atgggacggacggaggccgagaggcgtggcgggggagcagtggggccaggccagagacagctgcgctgtgcgggcagctagtcccagtactccgagtcggtcgcgggccgacaggcatcccctgagcgcctgctgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcactctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379677 - DNA, 2666 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaagctttttaggtggtttttcccaatggctggcacccatgcatctttggtactaggatacactgcatatccattcatgtcctgtgtctctgggcttgtgaagaataagatcctccccaccccaagagccagcgtttaccccctggagggtggtgctgaccccgtggaggccttgacagtgctcaggtgcaccaaggaagggacacaagtgtctgccagagagggcgggcacagggcaggagccccactgctgcctgagaaaaaccctaagtgatgagacacagttctctccagcggaaatcacagcaaacgcagatcccaccacagatgtgctcccgaacgcacaaggccacagccttggacctcttagggccctgccagaaaccacagcggctggaggtgacaccaaggaccaagtccccctgcggcctctgagtccctgcaggaggatacttctccggtgagcaggcgggagaagtgttggagagcgccgtcctggctttgtgttcccagaggtgagccgtgggtgctgtcgcgttctctacatccatgttacacaaccgcccagagcgacacgcatccccttagcatcacccagaccgacacgcaccgccttagtatcacccagactgacacgcacccccttagcgtcacccagagcctacacgcacccccttacccagaccgacacgcacccccttagcatcacccagagctgacacacaccgccttagcgtcac

SEQ ID NO: 379678 - DNA, 381 bp, Homo sapiens
tcacgcggtggtgtttgctaagctgtgtgtgccaggggaccagtgccatgggctgcatccctttatcgtgcaggtaggacgctggggtggccctcagtgggggcagtgtttacccccaggaagcactggtaatgtctggagtcatttttgtcataacaagggtggggcatgcttctggcatctggtgagtggaccagggacactgcccaggaccccagtgcatcccatagccccgcccacagtgcaaacagccccgcccacagtgcattccacagccctgcccacaatgcagatagccccgtccacagtgcatcccacaaccctgcccacagtgcacagacagccgcgcccacagtgcacagacagctccgcccacagtgt

SEQ ID NO: 379679 - DNA, 359 bp, Homo sapiens
caggcctcagggaattgatgaggagtctggaaatgaacacggattgttgatgtttcttaagcctccagtcctctagtccattgggaatgatagtcatatctctgtctgggtgtctccgggtcagactgtgtcccatgaagcctgtggcctggaggtcaactatataagggcacatggagagtccatcttttactccaaataagccttacccatctcctgcatttccagaaaaccatcttctcagctcttgagaatgaccctcttttcgctcgttcccctggagccgatctgtccttggagaagtatcgcgagctgaacttccttcgatgcaagcggatcttcgagtatgacttcctcag

SEQ ID NO: 379680 - DNA, 2853 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379681 - DNA, 2871 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacggtgaggctctgctgcacacagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379682 - DNA, 2865 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctgaaagacgatgcagttgccctggtagacgtgatcgctcctcctgactttgttctggactcaccgattggcagagccgacggcgagatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacgccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379683 - DNA, 2573 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcagcaatggcgcttgcttccatatctggcagctgtctacgccttagaccatttctccaagtcgctcttcctggacctggtggagctccagcgaggacttgcatcgggagaccgcagcgccagacaggcagagcttggacgtgagatccacgccctggcatcggccagcaagcccctggcctcgtggaccacccagcaaggaattcaggaatgccgggaggcgtgtggaggacacggctatctggccatgaaccggttgggtgtccttagagatgacaacgatcccaactgcacatacgaaggtgacaacaacatcctgctgcagcagacaagcaactatttgctgggtctcctggcacaccaggtccacgatggagcttgcttccgcagtccgctgaagtcagtggactttctggacgcctatcccggcatccttgaccagaagtttgaggtctccagtgttgccgactgcttggactctgcagtcgccctggcagcatacaagtggctggtttgctacctgctccgagagacttatcaaaaattaaaccaagagaaaagatcaggaagcagtgactttgaagcaaggaacaaatgccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggaggatacttctccggtgagcaggcgggagaagtgttggagagcgccgtcctggctttgtgttcccagctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaatagttttcaaatatgttacacagcacctgttcaagagtcgg

SEQ ID NO: 379684 - DNA, 1176 bp, Homo sapiens
gggaccggaaatgagaatggcgccgctggagatcctttcctgcttttggtttccctggcaggggttgaactgtggagtgtgtgggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtttttggatcagcagtttacagttctggttctgaaagacatctcacatatattcaaaagatcttcaggatggagatttttggatgttttgctctgaccgaattaagccacggcagtaataccaaggccattcgcacaactgcccactacgatcctgccactgaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcagatccgggacccgaagacccttcttcccatgcctggagtgatggttggcgacataggaaaaaaactcgggcagaacggtctggataatggtttcgccatgttccacaaggtcagagttcctcgccagagccttctgaaccggatgggagacgtcacccccgagggcacctatgtcagcccctttaaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcaggtatgaggttttcaagcatcct

SEQ ID NO: 379685 - DNA, 2197 bp, Homo sapiens
attgtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggtatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgccgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaa

SEQ ID NO: 379686 - DNA, 2149 bp, Homo sapiens
attgtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggtatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgccgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaa

SEQ ID NO: 379687 - DNA, 852 bp, Homo sapiens
attgtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccaggcacccctttcctcccccgaggatcctcagatctctcactgtcttcccttccctgagagcccctcattaccaaatcacctccctcttattctctatgtcagtggtcactcttatttcagaataaatcaacatattaaaccag

SEQ ID NO: 379688 - DNA, 1264 bp, Homo sapiens
ctagtgtgctgagggtggaagaaaaggggaaggcggagctaggtgggaagttcattggaatagacggtccagagaagagaatatgggtcagaagtcatgaggctttggcttagcatgggcagtgtggaaagctctagatccagtccccaaacttggccctagtccactgacttgttacataatcttgggcaaaacactgtaccttttgaacttcagctctttcacctgtgcacagtgttttcatgggagggaccctcccatcttcttctgccccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgccgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaa

SEQ ID NO: 379689 - DNA, 321 bp, Homo sapiens
ctgctgcactcgtccctctttctgctcttttgttttctgcccattgaagaagcccttgctgccccttcggaacgcagtctgggcctactctctgcacctctccagggaccagcagaatttagttctaagggagctgtgccttcacctccccgctcagggaggcacctaagctttctgagggggaattgggcccttcttgagagctggtggcttttctcccagatgcctcctggaaatcttgcggacatttgagcgagctcatcaggtgacctacagccaaagccccaagattgccaccctgatgaagagtgtcagcaccag

SEQ ID NO: 379690 - DNA, 740 bp, Homo sapiens
gctgaggcaggagaatcacttgaacccgggaggcggaggtaacagtgagccaagatcacaccactgcactccagcctgggccacagagtgagactctgtctccaaaaacaaacaaacaaacaaacaaatgaaaacttccaaggaaatggaagttcacaccaggccaggcttgtgagcatgaaacctacctgcccaaccccaccaaccaccccagtttgacaacatatccctttgagtgcaagacatggcagagaagcaaaaatgaacaaaaccaaccctgctggcactttcctcctcacccagcaaacactcttcttgtatttaagattgggtttctcaaactttttaaaatcactttctcctttaggataaacatataaatcttggctcctcccgacaacctgattctgatatttccactggagagtacccattcccagcataagaatcactgctatctctacacagtcccaccagccaaggttcagcagtattttcggaagtttgtattataaaaaaacagatttttttaaatcttaaaaatgtctaaatataaaatgcagttatgatgctgactttgcttttcaaactatacaactaccgctatctttcagatttaggccaagtgcaatggctcacacctgtaatcctagtactttgggaggccaaggctggaggatcactttaaagaggccagaaacttgagaccagcctgggcaacatagtgagaccccatgtct

SEQ ID NO: 379691 - DNA, 624 bp, Homo sapiens
tagtaccagctactcgggaggctgaggcaggagaatgctgtgaacccgggaggcagaggttgtggtaagccgagatcgcaccactgcattccggcctaggtgacagagcaagactccgtctcaagaaaatcgtcccaactgcatgtggtccttgggtgagatcatcttaaggagtactcagcaagggattgtactttgcttggttaggactggaatttacactctaattttggcccagtgatcttggaacagattgagcatctcaaatctgaaaatctgaaattcagaatgctccaaaacctgaaaccttgtgcgccgatgtgactttcaaaagaaatgctcattggagcatttaaaattttggattttcagatttgtgatgctcaactagtaggtataatgcaaatattccaaaatccaaaacagttctggtcccaagtgttttgaataaggaatactcatcctgtacaccaggaggtagactcaggcacagtctcgcccggcatctcacctggattttattgcaatagcctcctaactggtttctctgacttgaatcatactttcctttagtatgttttctatgcagctgccatggtatcctattaaaaaacaaaacaaaac

SEQ ID NO: 379692 - DNA, 590 bp, Homo sapiens
tactgtagcaaactgaggtactatgcattgatttcacagtctacttagttgatttcataattagttaatttcatgtatttttctacttttctatcagtctgaaaagttatatgttcctttcatcttccactcctttacctcactgaaacaatatggcctaggaactttctgatcagtcattcttcagatcagagcatgggggagcaatgtgggtgataaacactcggtagtcgctcaggtaattatctctagttcctttgggagggattaaaaattccatttcagaggcttccctgtatatttcttataatcatattggaatgaatataattcttatgacagttgtaagtgtaatcattgtcaactaatacttttattgtcctacttaaagtcttgagtttttttttaattgctatgataattattatatgtaatgtctggatcctacagaccctacctcaacaattataattaaaaatgctaaagtctcgagtaagcaaaaccaggaaaatagccttcacgtagatttcgtatcttagtactttgtatttctgtctgtctgagagaactacacattactaaaatagagg

SEQ ID NO: 379693 - DNA, 1262 bp, Homo sapiens
agaagttactttgaaataaattgaaggattagcagtggtgactgaggaataaaaattataatttaaaattgtccttaaagctggaattcttaacttattgaccttatatcctacatattataggactttgtaaatttaggctgatatggaaatgtatatttatatcaaatttaaatttttagaatgatggtgctactatattctaattgttaatttgataattgtaattgtaatttgttaatttgttctaataatgttttcatgacattattcatttgctgcttggcttgatggcataacaagtatgggttatttaccctgaaaaggaaacagtatcacccttccagaatctctatttacagctacagaagatgcaacacacctgtttctggaccacttccagatcagatgtgatgcatgctttagatcatttactttgatctaggaattactgtctggcatttcgtggtgtagggtaggtgtctccagcactgtataggtgtctggaattgagataagaatcaatttcaatacaaaatacattttttgcttaaagcacgcaaggattctatgaattcaggtaaattcacagggtggaaaacaggaactaatgttatatattcctgtagttatcttcataatgaagcagaaagaaaaacaaaaaagttacaaaaataaatgaaaagaactgtattttctagaattgaaaaataattcttttagatgatagataagatgtttacatcaacctgcaaaaagtcaatgttgaagaggtctcattgtatctcacagaattttgatttgcctactcacccacaggagacatttctgggacagtagcaacataaggtccatcccaaaactttggctcattatcattaatatcctgcactttgatgatgaattctgattcaggctccaggggctttctggtttctatgtccacagcctgagcacgaagagtgtagaaaggtttttcttctctatctaggctccttattgcatgaatgtcccctgtggtttcatcaatggtaaaaacggtgccagcgccatctcctgagagggtgtatttcgcagtgccctttcccttgtctaagtcggaatggagctttagggaagagagggagagagagaggaagagaaagagaaggacaaagaaagaacaccattaaaaggatgttgccaaattaaaaagtcataatttgcaatacaattcctttaatcaaaaatgttaaataaaaatcttatggttctgaaaaaaa

SEQ ID NO: 379694 - DNA, 388 bp, Homo sapiens
ttcaggctctacttttaattctagttctcttttgttgcctctaccactcttcagttatttcctccactgaagtcttgaacccttttacctcattcatgagggttggaatcaacttcttccaaactccgattaatgtcgatattttgacttcttcctatgaatcaccaacattcttaatggcatctagaatggtgactcctttccagaaggttttcaatttactttgcccagatccatcagaggaatcactacgtatggcagctatagccttacaaaatgtatcctttaaataataaggccttaagctagacattacttctacagtgctgatagatttgcttgactcagggttaccacaaaccttccatttgtaaaaaaaaataaaaat

SEQ ID NO: 379695 - DNA, 490 bp, Homo sapiens
ttggaccacaggtcctcctgtggaggaggggtctccagccactttccccagctctctcccctccactctaagtcaacattggttccaattacctccctcctcctcattaggagcccacagtactgataatgaccattttaaatatctttttctaaaaatatcaccaaaaacaagaaaggcacaagatagaaggctcaaagaaaatacgaaacatgtagctttaaatttttcatccttcaaaggaaggaccaaagataattaaaatattagtgaaggaagtacaggtagataaaaataggtatttacatatatgctgcccctttgggggggactttcaattttaaaaacttagctgataaaaacgataaagctggccgggcgcggtggctcacgcctgtaatcccagcactttgggaggccgaggcaggcggatcacgaggtcaggagatcgagaccatcctgactaacacggtgaaaccgtgtctctact

SEQ ID NO: 379696 - DNA, 655 bp, Homo sapiens
  misc_feature (649)..(652): n is a, c, g, or t
  misc_feature (655)..(655): n is a, c, g, or t
ctaagacgcgctacagcccttcctagcagagtttatccattcgtccccaagagcagctagaagagatttgaggtcatgacctcccactgccgctcaggggctgaccctatttaggaaaccaaagagggtgggttgaacctactctcacggacttggatccagtgcgcacacttgcctgcggaaaagggctctccccagccacccggagatgggggtaagaggaagagcagaggcttggggtagggccacctggtgtttaaacaggcactttctccttctctggggcttatttttgttcagaactagaccagagtgtttgaacctcctttgcaggagggctgggaatcctctttagagcacttaatcctatttatcccctggaatgtgcgtgctggccagtaggagggctggctttggcagctccctgacccccgcgctgcccgcccctccggggtaatgtggcattactggcccacagaggttttgagccaatcagctctgagactgggttagaatgtaacagctttaacttgggatttaagaagcttttaaaaggtaataatcctctgaaagaaaaatgacgtaaccacagcgtgtactatgaaagctgttattttaataaagaacgctgggccatgaactcataaannnnaan

SEQ ID NO: 379697 - DNA, 423 bp, Homo sapiens
ctgctcatcccatgcctggcagtgtcatggtaggagcctagggcgatagggccctgtcccagggctgctgggtgctgacctggtggcccacagtccagagcctgccacaggaggtgcaagacagagcaagctggacagatggaggaagccaggctgccagacaaggcctccccaccccacctggcacagaacaaggcgggtggtggggccaggagccggggtatgcccagacacctgcatgcctgaccaggagcccagaggctcagaacccaccacccagctgcaggtcagccctccctggggcgcaggcgtccccaacctctccccctgtgccctgaagctggacattttggggcaaagccagccaggagagccagactaaacaaagtggactcaataaagtggattttcccagaaataaaa

SEQ ID NO: 379698 - DNA, 373 bp, Homo sapiens
gtgaggttgagcagcttttcacatgcatatgaccatgtggatatcctcttctgtgaactacctgttcaagtctgaagcagatactatttggtagtatcaactaaaactgaatataatacataccctaaatttagcaattttgtacctgtttttttcttacatacctgtaatcccagcactttggggggccgaggcgagcagatcacctgaggtcggtagttcgagaccaacctgaccaacatggagaaaccctctactaaaaatacaaaattagccaggcgtggtttcgcatgcctgtaaatcccagttacttgggaagctgaggagggagaatcacttgaacccaggaggcggaggttgcagtgagctgaga

SEQ ID NO: 379699 - DNA, 912 bp, Homo sapiens
caaaaaaaaaaaaattattttctacccctcaaaacagccactttctcctccatctcctcttccctgatgaagaaaggcgtatgagcatctggacctcattgggtttaggtcatcatgttcttgcaattcctgtgtgcttatgcacattaaatgaatttgtatgccttttcctcttattaatctgcctattgtaaattcattttcagtgaacttcaaagggcagaggggaaactgtcccttggcctctacccctccaaggccccactttttcgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacgcttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatggcattaaccctcacttaacttttcagcctgccagcctgccctatggatttcggacttgccagccacacaattccttaaaataaatctctccgtctctgtctgttt

SEQ ID NO: 379700 - DNA, 1739 bp, Homo sapiens
caggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacacagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatccttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccactttttcgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacgcttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatggcattaaccctcacttaacttttcagcctgccagcctgccctatggatttcggacttgccagccacacaattccttaaaataaatctctccgtctctgtctgttt

SEQ ID NO: 379701 - DNA, 1568 bp, Homo sapiens
caggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacacagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatccttctccaggaaaaatctgtccttggcccaatgtgtaaacacttgctgagtgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccactttttcgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacgcttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatggcattaaccctcacttaacttttcagcctgccagcctgccctatggatttcggacttgccagccacacaattccttaaaataaatctctccgtctctgtctgttt

SEQ ID NO: 379702 - DNA, 1268 bp, Homo sapiens
caggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacacagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatccttctccaggaaaaatctgtccttggcccaatgtgtaaacacttgctgagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcggtgagttaaaaaaagacctgccctgggtgtcaagcacagtagttacaccgctggttctgctccctctgcttgggatacatgggcagggtgccctggtggtagggccttggtcaccagcaaagtcagttcccatgggatcctctttctgagctgatgcccactcccctgaagaaggggcttctattcaggcctcttgttgcaaggagcagaaacccacttaggctggctcaagtccgctgtgttccgctgttcagcatcctgtttc

SEQ ID NO: 379703 - DNA, 1709 bp, Homo sapiens
caggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacacagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatccttctccaggaaaaatctgtccttggcccaatgtgtaaacacttgctgagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccactttttcgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacgcttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatggcattaaccctcacttaacttttcagcctgccagcctgccctatggatttcggacttgccagccacacaattccttaaaataaatctctccgtctctgtctgttt

SEQ ID NO: 379704 - DNA, 599 bp, Homo sapiens
gtcagtcgaaagcgaaccagaagcaccgggcacagcagctcctctggctgtgtagacagacctggcaatgtggccgtgcagcccagacgatcagagagaagccaggcgttgaccaagccccaaggtgcctgaggccatggtgcaactctgctggtgactggggcaccttggagcagagcttcacccggatgggaaatcctcactcctgggtggcactccctcctggacaggcccggtggcagagtgtccgtgctgctgggtgctgtccccagccctcctggtccatcttcttaagatgcgtccactgctttatatttaaaattctctttttcacaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtatcacaatgtacttgaaactgttatctttgtgctctattgtttgaataattaaagaaattacagagact

SEQ ID NO: 379705 - DNA, 375 bp, Homo sapiens
ggaaattggtggtttcttttgtttgaattttttccaaagtatttttctttaagagtttatacactgcagtcatccagcttttccctgcctcgtgctttataggaacctttaaagaaatctgcacaagaataatctcttttttaatcgcattataaacctgttcatacgcaagtatgggaaatgtgaggatgttatcggagttgaatgggtcatctgttgaatatcatgtgcttgtttcacacaagcatacacatgttgggaattttgcaatcggcctgggaaaaacctggatgagggcatattctgtggggattccctttactccccgaagtaggagggtccccaaaggaaagaacaaaataaagagtgactgaa

SEQ ID NO: 379706 - DNA, 193 bp, Homo sapiens
gcagaatggggcctgccctttggatacagctcacactttccagtgtacccctgtccccaccactcctgtttgtctcccatctggctccggtaggcatgtgcgtttgcagctctgtattagctgatcctgttctcccagcacaccccgcactcccacccctccccgcctggcacatgccctctctcgcccatgc

SEQ ID NO: 379707 - DNA, 793 bp, Homo sapiens
ctgaagccaactacacagtttcaaggatctttgctggttttctttaatatgcttcttggttaagtgataaactgaatttttgcttcttggaataagatcagaaggcttattttgctatatttcaaatatgtggcttatttcatgatttgggctcttgtttgttgaagaacttttgaagctttttaataattattttcagttataattcacgatttatgagaagggtacagattgtgatgaactttttatacacccttaagtaattaacaagtcttaatctccaattttatgtttcatatcaaagaaagcgtttttattgaggaaattctactccactaaaattgatgcaagcatttgctgcctgcagacttacctcctaaaatgtggttgtttggtaagctcactttgcagactgttatatatcctaattccttgcgctgtaagccagcactagcaaatctagatacagcagaagccacgctgatacagtcaatatgtgaagcagtctgggcgggggtctctggagaactggggagcttctgcttgtctaaaagggtggctattcctcagaaacagttaagtgctgccactccagagcaggcctgttgccatcatcttctgacattaagaaacacaggaaatccagattgttgtgtgaattcatgaacaaaagattgaccactgcaagccaaatgaaacaagtttgtggccacatttggaccacatgccactagtatgcaatctctgcatcaaactattatgagtaaagaagaaacttggacaagcatctgaa

SEQ ID NO: 379708 - DNA, 1657 bp, Homo sapiens
  misc_feature (1)..(3): n is a, c, g, or t
  misc_feature (344)..(344): n is a, c, g, or t
  misc_feature (514)..(514): n is a, c, g, or t
  misc_feature (1437)..(1437): n is a, c, g, or t
nnngccacataaaaatgtactaatacctttatattaacttcttgtccgtcccagagaaagaagtgtcccgattccatactcagacttagcacctcccctgtgatttttgtttctatttcttactgcttttaattgtgaccctgctaaatctcttggaaagcttgtgaaagcagtgattgctggaccttacccacagagtctctgattttagtagtttgggagtaagactagagaatttgcatttctaacaagttgcctggtgatggtgctgctgctgtctggggaaccacgcttggagaaccactgtcttatagatagtgcttgagttttttgttttgttttgngacagagcgagaccctgattaaaaaaacaaacaaacaaacaaacaaaaacgcaaggtgactttaagttgaagagcaagcacttgccatttgagccctagccaaaactatgaactgtaatgtgggtgaggttgttcttttccatatttccttcttcttcacttctttcacnttacacactgaatccctattggctgttcaaacataactaacctcctccctgtgtaccaaacacctgaactgtctctcactttcccctctctaatccaaacttgtggcctcttaataggggttgatttttaggaagcttagagaaaaacaacaaagtgttgattttagtaacttgtatggtcataactagctaatagaattaatcttcatttacattttaaaaggagattttttttcttttttaagcaaaagtgtcctttggaaaagtatgtgtgggagggaagcatgttgtaagcaaagcaataaaggaaatgagtagggttttcctgtctttgactggtgtacagacctccaaagtcagagggattggtgttattctaaagagtcttcagtcctctctggcttactgaggtgtagttatagcatagtcaacagctcagggtttggatttaagtgcacagacctgggttcaaattccagtctttataagtgactgcaacattattcaagttacttaacatattcaagcctcagcttcctcatttgtaaatatcataagtgtactacctgatagacttgtgaagattatacaaaatagcattgtaaaagtacctagtgcataatagacattacctatatgtaagtttatactaccattattattttgtcagatggaatatgtattatgtttttattgggttgagtgttctgtcaatgtcaggtaggtcaagttggttaataacatcattcaagttttctgtctttactgactttttaaaaatatctctctgtcaattactaagcgaggattattgaaatctccaaatatcattgtgaatttgtttctcctttcagttctatcaaattttgttttatgtgttttgaaacagtgttattagtatatacaaatttaggattgctgtnttttcttgaagaattaaccccttttttatgatgagatacctctctgtgttcttgataatatggtccatgttcttaagtttactttgtctaacattggtataaccacttaagctctatttcattgtttcagagtatcacttgaacctggaaggcagaggttgcagtgagccgagaatgcgccggtgtacccccgcctgggctgcagagtgtgagactcctc

SEQ ID NO: 379709 - DNA, 417 bp, Homo sapiens
ctgagatgaaacagcctggatcagccaccatgataaataggaagaccttttatactagtatcccaaagggtgagagtaaactggcagaaagtaatcttggccccagacaaatgtcagctattttagttactagagaacatttttaaaaagtctatgtgtaagactaaatttttatatttgttatactaggttggcaaaaaatgtagaggaagtatatttattcaaaagttgttgtaatgtatcattttcaaatataatttttgttattaagttcagaagttattagggtcttttctttggaggctttttcaaggggaatataaatgttcttaatattatcagatatacttccagaattaatacatagagcggaccttgtagccaaagaagcacaactagtggaaaagtgaaaaaaag

SEQ ID NO: 379710 - DNA, 982 bp, Homo sapiens
gtatacctggctaatgaaggaaatccagattcgttgccaaaaccaagttttaaaggaatttgcaatccttcacagttcattcaaggaggcaatggaaattttgatgaagaaattttttaaaatctttcttaaaaggagtccttacattggcattgtatcatgactaaagtcttcctccctctctcccttctatgctttttgtttctgttttctatctttcaatgacatcagtttcatggatataaatggttaaaagacaatgattacaacacacagttgagtgacacaaatcttgttgtagtgttagaaatacatcaatacattgggatcataaagagaaatggcaagaaaaaaaatcttaagttaataacagaaaatgctgattcccacagtccgtgtagaaaataacacgtttttttttctgtcagtggagataactgagactagttaatattgtcaattctgttccttctgactgagccaggtgaggcaaaatttagcatatgagttgagggacaaaactattaccttggcaacataaaaattaatactgtctacattgtttactaggaaatgcatgcaaaattaatacactcttggtagtacaggttcgtttcacttctatagtgtgtggttaatagaaagctgattcaacagacgatagattcaacagacgatgtagaattgtctaaaatccagccaggcgcggtggttcacgcctgtactcccagcactttgggaggctgaggcggcagatcacaatgtcaggagatcgagaccatcctggctaacattgtgaaacctcgtctctactaaaaatacaaaaaaattagccgggagtggtggtgggcgcctgtagtcccagctactcgggaggctgaggcaggagaatagcgtgaacccaggaggcggagcttgcagtgagccgacatcgcgccactgcattccagcctgggcgacagagcgagactccatctcaaaa

SEQ ID NO: 379711 - DNA, 271 bp, Homo sapiens
gattcagcatttgaaaggtgcctgtggaaacagctgtgctggagggaagtgctttcaattcgtgcactcagcaatatggaaattaacttggccagcgcatgagcatgaataaatgcttagctgcctttgcaatcacaaagcagctttctatctttggcacttttcagacattcagtaaaacagactaaatttaatgccagatgacagcaccagactgtcttcagtgaaactcatgcaaaaaccttaagaagccacatcccccaacccctcc

SEQ ID NO: 379712 - DNA, 274 bp, Homo sapiens
gtacagtgcttgttcaggtcttttgcccatttctctatttaaatcgcttgttttttctaattgatttgtaagaatttcttgcatgctctaaactcaggggtcaaggctgtggtctggtgttggtgtgggtgttgcactcctgctgtcccagtcccaggtacttgggaggctgagataggaggatcgcttgagcctgggacgtcagggctgcagtgagccgaggttgcaccagtgcactccagcctgggtgacagagtgagatcctgtctcaaaa

SEQ ID NO: 379713 - DNA, 619 bp, Homo sapiens
ggagaaacaggggcacacgaaggttaagcaacctgctcaaggtcacccagctctcctgctctgaaccacatcctttgctaagaacttcatgggcagtatcccatccaaaccttgcaacaacccagaagggcctcttcttcagggaatggaagcagccgactggaccgggattggagtgtgtctcccacctgggggcgccagagggcacatatactgctgtactcgtttgtgccaccagagggcagcctccgcacatcgatctctactgcttccgagaactgtccaaaccggcgggactgagagagagaaacctggtccagggcagagaaagagaggagcccactgcagtgcgtgcaagcgatcttccacgcgtccatcctgaatgtgttaaaagcagcagttaaagagggagggctctggagttggactgtttgcgtttgaacccagactctgggcaaaagctgctgaacctctctgaatctaatagcctcatctgtgaattggaaggatactagcgaggattaaatgagagtgcataggaagggcctagccccggtgcccagcacagaggctccatatgtgtcaccgttgtcaatttctgactcatgtattcatctat

SEQ ID NO: 379714 - DNA, 699 bp, Homo sapiens
tataaattaacagctgttttaactttagggcctcttcttcagggaatggaagcagccgactggaccgggattggagtgtgtgtaaggctggtggagggagtgggaggcggggggctccggcagctggcattcttcgggggcagcctcagctggcacctcggggggcaccaggcagtggccagagcagggggtctccaggtgccggggactgaggctaccccctgctgtgggctgcagcttgctctcttctcaacttcccagctcccacctgggggcgccagagggcacatatactgctgtactcgtttgtgccaccagagggcagcctccgcacatcgatctctactgcttccgagaactgtccaaaccggcgggactgagagagagaaacctggtccagggcagagaaagagaggagcccactgcagtgcgtgcaagcgatcttccacgcgtccatcctgaatgtgttaaaagcagcagttaaagagggagggctctggagttggactgtttgcgtttgaacccagactctgggcaaaagctgctgaacctctctgaatctaatagcctcatctgtgaattggaaggatactagcgaggattaaatgagagtgcataggaagggcctagccccggtgcccagcacagaggctccatatgtgtcaccgttgtcaatttctgactcatgtattcatctat

SEQ ID NO: 379715 - DNA, 352 bp, Homo sapiens
agaaaaaaaagactgacaaaaaaggagacaagattgaaatccatgaataaggaggaatcactataggtcctgcagacatcaaatgttattaagagaatattatgaacaactttttgttaattattttaaaatttaggtaaaatggaccaatgtctttaaaaagttcaatttagcaaagctaactcaaatagagatagaaacttagaatattcctgtaactattaaaagaagcagtgataaaaaaagaaaacttcctatagagaaaaccccacagagagcttcatcaatgatttctgccaaatattcaatgaagaaattatgtcaatcttatacagttttctctagataatag

SEQ ID NO: 379716 - DNA, 517 bp, Homo sapiens
ttttgctggaggagcccctctgtcaagggtcgctccagtaaccactctgcaccccgagtgattgagtgcagagcaggaagcgggcagatatttgcagaaggaggctgggagagctcagggattagttcccagggagacctcccttttgaggccggactcctctcctgcagccgagcacgcagccattaaggaagtctttgagtttggtttaatggcccctctttgttttgaagtggctgtttactgaaccttcaaagcccgctcggcagcaggatgtgatcgagggcctgaataattggatgaggcaccccaataggaaacagggagcggggagcagagccaggactagccgacagccaagccctctgtctgagcctccgctggagggactgaggtcatcctgcaaccagaagttgacctggagcgggggtcccctggaacctggcctctttgatgttgtgctggccttaattaggaacaccctaattaagtcactgaggaggaagcttttttctta

SEQ ID NO: 379717 - DNA, 835 bp, Homo sapiens
gcttcttgaatacatgtataatttctttagaacctcactcaggcagaatatgccatcaccagtgatgtgagaagagggtctttgcccttttatcccttgttgtctatccaatgcctagaacagcagtaggaattaggtaggtgcagaattcatatcaaatgaatgaaactgattcaccacaaaggactggattctgttttgcaaacagcattttcatatttttcattttgcggtgtgctctgtctgaattaactgtcctataacatcacttacaatcacaactctctctttgtggctctgactgaatttttgaccagcttttatattgaataacacattctatgatttgcaaaatgtttatttcaaccaattttatccaaaattatatttctagtcttttgtacaatttaagtttggttcattccccatgaaggtgtcactttataataagtagcgtgtactcgcagagatgaattctgaggaactgaggtctcccgccaacagccagcatcaacttgccagtcttgtgagtgaatcatcctggaaatggattcttcagccacaatcaagccttcagatgatggtagccctggctgagagcttgactgcaactgtgtgagtgatcctaagccagaaccaccagccaagccactcacaacttcctgacccacagacactgtaatagatgtttattgttgttttaagctgctaaatttagagtcatttgtttcacagcaatagataatggatacatatcctaattactaaataggtagagatgagacaaatgatctgtaggaaaggaatacagttgtacaacagcaaataaacaatg

SEQ ID NO: 379718 - DNA, 341 bp, Homo sapiens
tgggctcaatagaggatattcttacaatttattttacgattttagggtttttcccttgtgtagaatctttaaaatactttgccattttatttgatgttgattatttggatgagttacattattctgaagaaacaaactgcaaaaaatagaattttttggcaagcataattgtatcctattactgtatgcattttaggaatatagatagcagccttaattgaagtgagtataattataatatgctaaggtttaattttaacatgaaaaagaattggagtgtcagataagccttattatttaaagcatccctctaataaaactgcactttttactgacaggga

SEQ ID NO: 379719 - DNA, 202 bp, Homo sapiens
gagatgctactgttcaaaatatgactgtggttgtttttaaagcaaattttaaaattggttattgtatatgtaatagtacttatacttttcattataagtattattatgtaataagtatacatgtaatacttaggtttgtagatgcagaaaaaattctggaagactctgtccaagcttttggtagtggttattttttaggagt

SEQ ID NO: 379720 - DNA, 389 bp, Homo sapiens
ataattgattttgcataggaacaacaaaagtctcaaggaattgaagtttttaataccccccttagcactttactttcaccaaaacctcctctttctagtacatgagcagttttgttctttgtgatgttttcctctacattctttagaataattttgttacttgacaactagacttgtcaatcgtcttagactcttttgaaaaatctaatctttgaaaatgacacaaattcctttattgctttaaggctgttttcattcacccctcccacagccccctccactgcaattttttgttttttgcggggatttttttctttcatctctcttcttttaacatgatgctgtgggtagttttcaagaattctataaagaactcaacaaaaagtgta

SEQ ID NO: 379721 - DNA, 1872 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggagatggatggtccatttgctgcatctgttccaagagggaagctaaggagtttagtgaaaccagttgaactcgtggaagcagagagtggaatggcggttactggaggctgtgcgggggacggactgggaaaggagagacgctggtcaaagggtacaaagtgtcactgagaccggaggaacaggttctggtgatctgttgcacagcatggtgactatagttaatgataatgtattgtctgtttcaaaattgctaaaacagtaggttttaaatgttgtcatcacaaaaagattacaagtaggggagatgatagatatgtcagttagcttgatgtaatcattccacaatgcaaacatatatcaaaacatcacattgtgcctcataaatatatactctcctcttttgtcaattaaaaatacatattaaaaaaacaaggaaaaggcataccacaggattgaagaaagacttggctcttgggtgtaatcaattgctgatataataagtcacttcaaaaattttagaaagagaaaaagagtgcagctaaggagtacggttaaaattaattgaaatacgcaaaggacccatcaatttgaaagtgctacctacacattttcatagacactttgcatccagatg

SEQ ID NO: 379722 - DNA, 3487 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379723 - DNA, 3526 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379724 - DNA, 3671 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatccagagtcttgttttgtaacttgatctttataatggtttttttaacaaaaaaaaaaaagtgggggggggccaaattaaattgggcggcaaaagaaagaagaaaagcgaagggggttcccaaagggggggggaaagaggttggtaagaag

SEQ ID NO: 379725 - DNA, 3240 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379726 - DNA, 2528 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctaacctttccgggaccgtgcacga

SEQ ID NO: 379727 - DNA, 2020 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcagggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggtgagaagaaagtccttccctcgcttcccactgcttgtggaaggcaatgtcgggttggcgctttgtcctctggctctgcgctccatgggctcttccattttatttttggttattgctgaatgagagagtctttgctaaaaacacaataacaaaagcaggctctcttctgttttgggcttagccgatgctactgggttggggtggaggaagcactccaggggatgagaagagatgctcccgcttctcttgactcgacttcatcaaagacaattgcttggctattctgggagaggactttgtttacagatggatggtccatttgctgcatctgttccaagagggaagctaaggagtttagtgaaaccagttgaactcgtggaagcagagagtggaatggcggttactggaggctgtgcgggggacggactgggaaaggagagacgctggtcaaagggtacaaagtgtcactgagaccggaggaacaggttctggtgatctgttgcacagcatggtgactatagttaatgataatgtattgtctgtttcaaaattgctaaaacagtaggttttaaatgttgtcatcacaaaaagattacaagtaggggagatgatagatatgtcagttagcttgatgtaatcattccacaatgcaaacatatatcaaaacatcacattgtgcctcataaatatatactctcctcttttgtcaattaaaaatacatattaaaaaaacaaggaaaaggcataccacaggattgaagaaagacttggctcttgggtgtaatcaattgctgatataataagtcacttcaaaaattttagaaagagaaaaagagtgcagctaaggagtacggttaaaattaattgaaatacgcaaaggacccatcaatttgaaagtgctacctacacattttcatagacactttgcatccagatg

SEQ ID NO: 379728 - DNA, 3583 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379729 - DNA, 293 bp, Homo sapiens
atcttttatgaattatttattttctttctcagaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaagctggcagctaggtctgctggggcacaccgagcctgtgagggagggaggccagcatgcggtgctcctgcccggggctcctgcccggggctcctgggatagccgc

SEQ ID NO: 379730 - DNA, 3622 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctatt

SEQ ID NO: 379731 - DNA, 3530 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379732 - DNA, 3425 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcagggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatta

SEQ ID NO: 379733 - DNA, 1925 bp, Homo sapiens
acacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggccggggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtaaatgtccaccttggaaaccctttgcagactgtagtcttctcagaactgcatgccctctggctgaggatattccctgaggccatgagagctcaggacaggaggagtccgtcagtggaccgaaagaactgtctcctcgttgcttgtattgcactgcgtcttggggctcctgatagtaaccttccatctttggacctcagctgccttttctatacacccttccaggtgtgacacctgtggaaaatgtca

SEQ ID NO: 379734 - DNA, 441 bp, Homo sapiens
tggtctcgaactcctgacctcaggtaatccaccgcctcatcctcccaaaatgcattatctcttcccaaaatgcattatctatttcattaagaaaaaggagaaagcaaccatgctaagcttcaaataaaagcatgtgagcacacctgatgacgctagacccactggaatctcgcataactcatcctgaacgtgttgggaatcaagtctctcaggattagccctggtaatctgaaagtcaccagtcatcaagaagtggcatctctaccatgtggtgcaatcatagccctgaactcaaatttctgtctgatatatttgatgtgatccctccttttatacccttttaacttctgcttggagagacccactgaccttgtagctgactgtcagaacttttccttgccaggccagcaataaatttggcattgttttggacattgattt

SEQ ID NO: 379735 - DNA, 552 bp, Homo sapiens
cttcatttctgatgctgttctcgccttaaaaccaggtcctagcagagctgtgcatcgcccacaggcggtggccctgctactagcgttaaaggtgagtcacgtttgcctgatcctgggcccctctgtctcagtagtccattcctggtatttattcccctggatcccataactagtggagaaggacaaggactcctatgtagatatgaggtgatttcagaacttccttcaacctactactaaggtacagtagtccatggtttcactttctgccatttcagttacccttggtcaactatagtctgaaaataggcaagtatagtacaataaggtattttaagagagaccacattcacataacttttattacagtatattgttataactgttctatttttattgttcatttcttattgtgtctaattcttaaattaaactggccaggggcagtggcttatgtctgtaatcccagcactttgggagggttgctagaggccaggacttccacaccagcctgggcaacaaagcaagaccctgtcgctacaaaaaaaaaga

SEQ ID NO: 379736 - DNA, 930 bp, Homo sapiens
atgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcatgatatga

SEQ ID NO: 379737 - DNA, 384 bp, Homo sapiens
ttgagtgttctcttatttacaactgaagttgataagatggtattaaaagtgagattcctagtaagtaaacttaaaggcctgaaggaccagtgattaatgggaagtgctaataagtcatatttgaggttatccaacccgagattctgatttaattggtttaaggatactatcaccttgtgggttagatttgaaaaataataattgctttaaggaaggaacctgttggtatttaaacaaaaaactttccttcctgattcttacatgccgtcacttagacaaatctctggtctacatggctggatctctttctgctagttaaattctgtgctaccctgtgaaaaagaactgagattaataaaacggtagtgagaacacagggaaaga

SEQ ID NO: 379738 - DNA, 564 bp, Homo sapiens
tacaatagcatgttaatatttatgctctaatattacttaaaaaccagaatattaggctgggtgtggtggctcatgcctgtaatcccagcactttgagaggctgaggcaggtggattgtctgaggtcaggagtttgaaaccagcctggccaaaatggtgaaaccctgtctcttctaaaaatacaaaaattagccagctgtggtggcaggtgcttgtaatcacagctactcaggaggctgaggcaggagaattgcttgaacctgggaggtggaggttgcaatgagatgagatccagccactgcactgcagcctgggcaacagagtgagactccatctcaaaaaaaaaatcagaatattaaattacatgtattgaaatatatgtaatcacagcacatataggaaaattaatggaaggaaagactccattatatattccattgcactatttttttcctgtgcatactaatagcatcaattagtacagtggtttttcgcaaaatttccagatggtgattatatgaaaaatttaaaaaatttactcgtattcatcctcaaacttaaaaaa

SEQ ID NO: 379739 - DNA, 460 bp, Homo sapiens
taagcaaagtttatgtacttctgaaataccacccaggttcattccagggaatgtagtttggttgcgattctacttggaactgtagacacacatgtcccatcaaacaaccttctcaaacaagtgagagcctaactcagactccggcgtgggctgccggggcccacggatgcaccaaagaaacatgcagctgggcatagccatgtcctctaaagagtctttcttgactttaaaacaccatcatagagacctgccctctcccacggccatgccagagctctgccctagtccaaacaatccagccagagctctatcagctccaaaatgggcaattcagacccaagtcataaacctctgtaaacagacttttcagtggaattgctgcccttttaactcttgcttctctgcatatattttattttatttatttattttgcgacagtctcactctgttgtccaggca

SEQ ID NO: 379740 - DNA, 152 bp, Homo sapiens
gtcacctggctctcccatgctccgctgtggctattttaaacccttccaatccttcacaccctctgaccttccttccggcatactcatccccagcagatgattttgcctcctgctttacagggaaaacagaagctgccaagaaactccctcag

SEQ ID NO: 379741 - DNA, 444 bp, Homo sapiens
gaatgagagtcaaagtgtttcatggtttttaaatgtttatatctagtaatcaatcttctaggaatctatcctaaggaaacaatcgcagagaaagaaaagcaaaactatccacagagatattcattgtcaggttatttagaatattgaaaaactggaaactatctggccaggcgcagtggctcacgcctgtgatcccagaactttggaaggctgaggtgggtggatcacaaggtcaggagttcaagaccagcctgaccaatatggtgaaaccctgtctctactaaaaatgcaaaaattagacgggcatggtggcacgtgcctgtagtcccagctactcaggaggctgagggaggagaatcgcttgaacctgggaggtggaggttgcagtgaaccaagatcacaccactgcactccagcctgggcgacagagccagactccatctc

SEQ ID NO: 379742 - DNA, 987 bp, Homo sapiens
  misc_feature (14)..(15): n is a, c, g, or t
gtctcgctgcaggnntggccttcacttttctgcgtcctcttactcctagaggcccagcctctgtggcgctgtgatctggttatcgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggccagacctgattacctgtctggaacaaggaaaagagccctggaatatgaagagacatgagatggtggtagcccactctgtgttctcgttttgcccaagacctttggctagagcagcatgttctttccacaaaagtgacactgagcagatatggaaaatatggacatacgacttacagctataagacaaggctgtacacagtgtggatgagtgtcacggcaacaccaaggcaggttataatggcacttaaccaatgtccgacacttaccacaagcaaccactatttcaactgtcaactcacctatgtaaacagtcatgcactaactttccacaacttctcaaatagacacacagcatccagacatactgactacatcacaccctcccagcatgctcaccgacctgtgacgaaatcactttgcatgctttcacgcctaactcagccctcgcagccattcatactcgacagacatactaccaatgtgacagagtgaagtaaaacacctttcaaattggttcacaaaaacacttccctaaaccctacgaaaatttacattacttaccctacactaacccctaccaaaatgttgaccgatataccttcacataccatttaaacctattctctatcaatcccttcacactatacacgtaacaatatcgacacttgccccacaaaacccccactacacctccctcacctgcacaaacaccattcaacacttattc

SEQ ID NO: 379743 - DNA, 913 bp, Homo sapiens
  misc_feature (14)..(15): n is a, c, g, or t
gtctcgctgcaggnntggccttcacttttctgcgtcctcttactcctagaggcccagcctctgtggcgctgtgatctggttatcgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggctctgtgttctcgttttgcccaagacctttggctagagcagcatgttctttccacaaaagtgacactgagcagatatggaaaatatggacatacgacttacagctataagacaaggctgtacacagtgtggatgagtgtcacggcaacaccaaggcaggttataatggcacttaaccaatgtccgacacttaccacaagcaaccactatttcaactgtcaactcacctatgtaaacagtcatgcactaactttccacaacttctcaaatagacacacagcatccagacatactgactacatcacaccctcccagcatgctcaccgacctgtgacgaaatcactttgcatgctttcacgcctaactcagccctcgcagccattcatactcgacagacatactaccaatgtgacagagtgaagtaaaacacctttcaaattggttcacaaaaacacttccctaaaccctacgaaaatttacattacttaccctacactaacccctaccaaaatgttgaccgatataccttcacataccatttaaacctattctctatcaatcccttcacactatacacgtaacaatatcgacacttgccccacaaaacccccactacacctccctcacctgcacaaacaccattcaacacttattc

SEQ ID NO: 379744 - DNA, 540 bp, Homo sapiens
gagacagggtcttgctccatcacccaggccagagtgcagtggcacaatcacagctcactgtggacccaatctcctggactcaagggatcttcctgcctcagcctcctgagtagctgggactataggtgtgcaccaccatgcccagctagtttttgtatttttaataaagatgaggtttcaccatgttgcccaggctgttctcaaattcctggactccagtaatcctcttgtctcagcctcctaaaatgctgcgattataggaatgagccaccatgcctcgccattgtagtgttattcttaatgatgttaaaatgttcctatctttgaccactgaaagcctctctaagttagctcctgggtcctcctaatatgaccttgggtgtcttcactatcttctttgttatgtgtatgacaagatattccaagcttatcttgtgcattttttctctgtagcactggaatcaaccaagatagagtatgagagaaggatcaagggtaagttgtgttctcagggcactgccaagtttcatttaaagcaaa

SEQ ID NO: 379745 - DNA, 376 bp, Homo sapiens
agaaatgacttcggcagttatttcttaagagttaaaaatctataatttttacctgtcatctaggtaggccagttgaagggttgaatgatgaagatagaagagaagtgatagatgcataaaatggttggaagtggcagtttccctccttgaaagaaggcagatattaattcttttatgaacctagctttctttatgcactaactcttggactgtctcttggcaccaaaccttcccgaggtaatgaaacagcatgctggcggacccagggcaccagagcaaggtcagggctgtgaccactttcaaaagattttccaggaaattattctattgaataatgtttaagtttccacagaagctataagcagagtgtgctgca

SEQ ID NO: 379746 - DNA, 273 bp, Homo sapiens
ttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattcctttgagttacttccttatgcatattttactttaacaggaagagg

SEQ ID NO: 379747 - DNA, 3853 bp, Homo sapiens
  misc_feature (2107)..(2107): n is a, c, g, or t
  misc_feature (2394)..(2394): n is a, c, g, or t
  misc_feature (2761)..(2761): n is a, c, g, or t
  misc_feature (2999)..(2999): n is a, c, g, or t
gtggatctaccattctggggtctggaggaccatggtcctcttctcagagctcccctagggagtgccccagtggggactctgtgtggcggcttatatctcacatttcccctttgcactgccctagcagaggttctccatgagagcttcgcccctgcagcagacttctgcctggatatccaggtgtttctgtacatcctctgaaatctaggcagaggtttccaaacctcaactcttgacttttgtgcactggtaggcccaacaccatgtgtaagccaccaaggcttgcaccctctgaggcaatggtctgaactgtaccttggccccttttagccacaactggtactggaacagctgggacacagggcaccaagtcccagtgatggcagctgcagcccatctggagcagctgctgcaaagatgctggctgcagttgggaaggcacagccggacctgcttgctctgcagagccagcgggacccaggaacaggcaggagcccttctcccttccgagttggtgcggagggagccccatgctcctgggtgcaattgcagccacccagctgtggactagggcattcctatgctctcgggggcccaggatgcctctcttcccccacatgctcagaagtgcctgctcctactgcttggcctctccccattcccagtgcccactctgactttggagaaaagctgtggccaagcccgggcactgacatgacctggccaggtgtgtgtgtgcttgaggagatgctgacacaccagccccctgccacctcagctccctctggactttgggcgctgatgaacgtgggagggaggccaagggcagggctgagggtgactcaacgtggtactgcaggcgtccctcagctaaaacagtctgggcaccatgaacagcagtgggagggagacaggctcctgggaggaaagggacaggtccctgctgaaaccccaccttcaagccagggatagcctgaagcctagggtccaggctgccagttccactgactggagtgaaaacttacagtgaattttccaggcccacccatggccacccatgggccaatcagcacacacttcctcccctctgaagcccataaaaaccgcaaactcagccagactctggcagatgataggacgacctgcctgcaggtaagagctacccacttgggtctcctctccactgaggactgcacactcgacaaaatgacctgcctgcagagaggaggtacccactccgggtctcttctctgctgagagctgcagttgtcgggaggaactgcctgcagaaagcagctacccatgacaggtctcctgagagctactcttttgctcaataaagcaccttgttcaccctccagttgtccatgtagctcattcttcctggacacagtacaggaactctggacctgccaaatggcaggaccaaacaagctgtaacacaaactgtgtcaaatacaccctgctgctcgccatgttgtgggtgacgatgaggagacaagagaggagagaagagctgcagcccttcagggagcctggacttaggagctccccaagccagggctgtgacatcctctttgtggctctgcagttgccggcatctccaagtttctgggtgccaccatgttccacagtgcttgtagtgggagccacttgtggtacacctgttccagccacagcaaggagccggcgcccatactggcacctggacctgcctgccccgccacagccaccatgcctggctgtgcacactgtaccccgcgctcgctcactcatgcaccccttgctgctctgcacctggcttgccgttggcagccgtgggatctgggccagtagtgaaaaccaagcacagcctgctgggtcaagtgggcagaacaagcccagtgggcctgagcaaaacttgggcaaaggcaacacttgccacagaggtttctggctggtgaagcgacaccctaaggatcctgtgataccgaggctgcacacagcagcagggccctgggcccactccactaaaacatttttctctcctaggcctccaggcctgtgatggggctctcttcattaatgcacctgtttggccctgccaaacggagggactgctgccaanatctctgacatgtcctggagacattttacccatagtcttggcaattaacatttgagtcttttttacttaagcaaatttctgcagctagcttgaatccctccccagaaaataggtttttcctttctactccatggtaaggctgcaaattttccaaacttttacgctccgcttcatctctctcaagttcaaagcttcacaaatctctaggacaggggcaaaacactgccagtctctttgctaaagcatagcaagagtcaccttcactccagtttccgacaagttcctcntctccatctgagaccaccttggcctgcacttctttgtccataccactagcagaattttggtcaaaaccattcaacaagtctctaggaagttccaaactttcccacatcttcctgtcttcttctgagccctccaaactgttccaatctctgcctgttattcagttccaaagtcacttccacattgttgggtatctttacagcagtgcccactaccttggtaccaattctctgtgttagtcccttttcacagtgttataaagaaatacccaagagtggctaatttataaagaaaagagatttaattgactcacagttctgcatggctggagaggcctcaggaaacttacaaatatggcaggaagggaancaagcacgttttacatggcagcaggcgagagggagtaagaacagagaatactgccttataaaaccatcagatattgggagaattcactatcacgaaaacagcatgggggaaaccactcccacgatccaatcacctcccaccaggtctctccctcaacacctggggattacaattcaagatgagatttgggtgtggacacaaagcctaaccataacagaatattaaaagaatgtagggnaccctttaaaaaggtgtataagcaccactacaactgctctcaatactacagcctttcattattttaagtgagaagcatttagactcatcacaactaaaaaagtttgatgacctcataccagtttccccatcatttctctacgtagttttttccatgtatcccagacttcatatctatgaatcctatagtcagcatccctgcaattttaaagacagcccaacttcaaagtacttataaccttgtacaatcatttcagctactagaaatacacagaaaattaaaattgacttaactaaatgtaatgaaattttaaaatgtatgctaacctattctccctaaagtgacaccaagtgcttcaataatctctgacaatttaactgcattagagccaactggttttatcattgtcagtgggtgtttcgatgcagtctctttgctgcatcactcaaatatgtgatgaagagccatatcacctcccaactgttcacagatttggaaataagataactaaacctcacaattcacatcaaagaatacagaatattcacatcctatctcatttcacaaagggtttggcacctaattcaaaagaaaatcttgtccgggatatccaaaataggttcttacattccattttatgtataaatatggtcagttcaggtttacttgtcactgggggaggatctaaaatcatttccattttcttgtacataaagcagtgtcttgaatctgactttttaatcacaatggacataaagtatttcttacccaagagaaaatttagttcatctgtcattgagggagaaacaaactgattaagtgtgatgtggcggctccctcaattaagcagttcc

SEQ ID NO: 379748 - DNA, 814 bp, Homo sapiens
atctttctactccagtttgcctatcaggcttctcatttttcacttcacttagtttaacttcagtgctatccaaagtgtccagtccacaaactaactgctcagtccatgacagaaaaggaatttgtaccatagtgtgccttaactgtggcattaagcccagtttagtttagtttacacttttttcctagcaattattattatatgatttatgtttgccgccagctccttatctcgttatgaataggtaacaagcagttcacagtctggcaccatacttcaagtagcactggcttaaatggaaccctctctgggcaaaactaaggagttagtcagatgttctgtgctccataacacctcttttatttttcagtatattttagaatttatcacattgtactttaagtatttctggctgtcttattaaagaggccaaactttttttgcaggcggtgggagatactcctccttgaggagcacagctaccccataggcagtgtgctcagaatagcctgaactaccatctctgagagtccagaaattcagaaattttgtcttgttcttctttataccttagtagacatttgaggtgtgttcgtttgtttgttttgttttttcatgtaataggttctgaaccaacatttgttgaaaaaatgaatggaagcctgaaatataaataaggcttttagtaaaaaaaaaaaaaaaaaaaaaaacttataattatttcattatatgtactcaagctcgtcatacattctttaatgtgttctaaagatttgcctttaaactttaaatgtaagtatttttaaatgtattt

SEQ ID NO: 379749 - DNA, 282 bp, Homo sapiens
agctgctttttaattcttctcacttcacagagaaaagaaatgctaaggcaggagctccctcaacttcctgtcctcatcattatgccctagaatttctctacagacttcccatccttactgtcctcctgtctgtcttagggaaggagatgcacgttcatgtcaagctcaagctacccatcccctaaggggttgtgttccttctaccacttcctccttcctataccttcaacttttccattcatcagggatctggataacttctcaatggatccagctactccc

SEQ ID NO: 379750 - DNA, 184 bp, Homo sapiens
taccaactacatatcttctttgaggaagtgttaagatacaattatttgggcttctagttcaacatacaaatagtgtagccctcaaaaaattcagtttcagatcttaaagatttcattttctttttacttggtctcagtggaaactctcaatttctgtctgttccatctattacgtaagattttt

SEQ ID NO: 379751 - DNA, 339 bp, Homo sapiens
ggaccacaaggcgacagtccccgtatctctgctatcatgaagactggagtcacagcccagtttttcactgaggggggtgcttcatcagtgcacacctgatgaagttggaaggaaagttctatgccagggcatttgcctcctccaagtttcatcatcattcaccaaataagcataattgctccgtgtttaagaggtgctgggaacagaggcactgctggtaattgcctaatgggccagtgaaatgaggtgtgaggcacatcggtgtgaaaaaagcaatagccacaagtttattaacattgaaaattaaaataagctcggccccagccaggcagtccttgc

SEQ ID NO: 379752 - DNA, 396 bp, Homo sapiens
atgaatgaatggaatgaatgggtctgtgggatttagtgatctaaaaccactcggggatcacaagtgcaatgttagcagaattaagggaggaccacagtgggctggagagtgagcaggagagggagagagggaaggcaagacagcgtgtagggaaaaaagagatcagactgttactgtgtctatgtagaaaggaaagacataaaagactccattttgaaaaagacctgtactttgaacaattgctttgctgagatgttgttaatttgtagctttgccccagccactttgccccaaccttgagctcacaaaaacatgtgttgtatgaaatcaaggtctaagggatctagggctgtgcaggatgtgtcttgttaacaaaatgtttacaggcagtgtgct

SEQ ID NO: 379753 - DNA, 179 bp, Homo sapiens
cccaggctagagcacagtggtgcaatcacagctcactgtagccttaaactcctgggctcaagcgatcctcccacctcagcctactgagtagctgagaccataggcataagccactgtgcctggcttgaaactggcattacaaatgtaattaaacctgctctgtagccttacccactact

SEQ ID NO: 379754 - DNA, 393 bp, Homo sapiens
aggaattgaccggtagtttggaaataaccctgcagtgtattaagtttttaaaagctgagggcaagaagaggttatcaaaatagcccaggcctaaattagaaattttattttaaaggatattatactgtaagaatccacagaatttagcaatttctaatccttataatataaaaatatatatctttcattcaggataaaagtcagtggttggctgtgtgggactaagacaagggggacttatcaacatgcatgaccaatagtcaaaagaaccccaggagttgctaagtagaggttcattattagttatgaggggttctctacactctactaaacagatatcatctggtggatgaaacacaacagccaaggtctcaaggcactttgtaccacgag

SEQ ID NO: 379755 - DNA, 478 bp, Homo sapiens
ttgagatggagtctcgctcagtggcctaggctggagtgtagcggtgcgatctcggctcactgcaagctccgcctcccgggttcacgcccattcttctgcctcagcctcccgagtagctgggactataggtgcccaccaccacacctggctaatttttttttgaatttttagtagagacggggtttcactgtgttagccaggatggatggtctggatctcctgacctcgtgatccgcccgcctctgcctcccagagttctgggattagaggcgtgagcccctgcgcctgtccagaattcatattttttaaaggacttgaataatctgttattgctttgggctctcccagggtccccgtcctttttcatgctgttatttttgccttacggttttggtttttgactgtcttactgaatgtttttggctattctgttctccttttacaaatcagaagagaaccacagggaataaggacagtt

SEQ ID NO: 379756 - DNA, 2756 bp, Homo sapiens
  misc_feature (585)..(585): n is a, c, g, or t
cccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcaggtaaagctccagatggctctggaacttatgaggaaagagttggaggacgccttgactcaggaggccaacgtggggaaaaagactgtcatttggaaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccngccctgggtctgctggagggtgtgagaggagtcctgagcagaagtaaggctgtcacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacgacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctctcgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcaagtgtcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactggccttcttttggataaacgtggttttaaaaaataaataataaattttcggggggcacccaggggtgctcccgcctgtggaaaccccc

SEQ ID NO: 379757 - DNA, 581 bp, Homo sapiens
tccaccacattctttccgcagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacgacaatagcagggtcaggaaattgggcatccagggatcatttagatcct

SEQ ID NO: 379758 - DNA, 1170 bp, Homo sapiens
ggaagcagactccagagggcctccctgttgtccagggccgttggctccctgagctctcctgtctcctttgggatgcgacttagggctagagtgttcttttcttcacacgttagccattccttacggctcttcacgttccacgcctagatgtgaagtgggacatagtcttccattgctggctgtccctgaggaaacagacatgagtcttggaggttctgaatgattttattgctaattatcacagtgacatagactagaacagaaattagaagcatagtaagattgccaaaatcagagaatcttgcaaagttctgtaattctaagtgttgttctagatttcctctagagaaggttattagaatctccattgcgtttctctttctccttctctttcccttgaggttaggaaacaggttaaaactcagagaactccaataataatggtttaaaaacatcaggggcttcctgtatctcctgtcaggaagccgaggaataagcaggctggggctggtgggcgtcaacatcccagttttgttctatctttctgtcccacctgcactgggatgtggcttctacactcgaatttgcttcttggtttcaagacagtggtgttctttccatagctgagcagattattttgagaggtgggtgatatgtgagagagaaatctggaaccttcttctgggtagatacaggataagatagatacagggtaaaatgttgagcactttgtacatgctttgagagcataatctttgtcatctgtttttttcccctagacaatatcaggttaccgtcaacattaatccatttaaaaggacatggactgttgccattaatacttttggattccatataacccttaacacaataacttctagaaaatgtgtgtgccgtagacacaaagaagggaacaatagacaccagggtatacttgagggtggagggtggcaggagggtgaagattgaaaagctgcctattgcgtgttatgctggtttcctgggtgacaaaattacctgtacaccacacccctgtgacacacaacttactcatgtaacaaacctgtgcatgtaccccttgaacctgaaataaaaattggaaagtaaaaaaaagtgtgtaaatatatttagttgaatcaaataataaagatgaatcattatgaattcaca

SEQ ID NO: 379759 - DNA, 1106 bp, Homo sapiens
ggaagcagactccagagggcctccctgttgtccagggccgttggctccctgagctctcctgtctcctttgggatgcgacttagggctagagtgttcttttcttcacacgttagccattccttacggctcttcacgttccacgcctagatgtgaagtgggacatagtcttccattgctggctgtccctgaggaaacagacatgagtcttggaggttctgaatgattttattgctaattatcacagtgacatagactagaacagaaattagaagcatagtaagattgccaaaatcagagaatcttgcaaagttctgtaattctaagtgttgttctagatttcctctagagaaggttattagaatctccattgcgtttctctttctccttctctttcccttgaggttaggaaacaggttaaaactcagagaactccaataataatggtttaaaaacatcaggggcttcctgtatctcctgtcaggaagccgaggaataagcaggctggggctggtgggcgtcaacatcccagttttgttctatctttctgtcccacctgcactgggatgtggcttctacactcgaatttgcttcttggtttcaagacagtggtgttctttccatagctgagcagattattttgagaggtgggtgatatgtgagagagaaatctggaaccttcttctgggtagatacaggataagatagatacagggtaaaatgttgagcactttgtacatgctttgagagcataatctttgtcatctgtttttttcccctagacaatatcaggttaccgtcaacattaatccatttaaaaggacatggactgttgccattaatacttttggattccatataacccttaacacaataacttctagaaaatgtgtgtgccgtagacacaaagaagggaacaatagacaccagggtatacttgagggtggagggtggcaggagggtgaagattgaaaagctgcctattgcgtgttatgctggtttcctgggtgacaaaattacctgtacaccacacccctgtgacacacaacttactcatgtaacaaacctgtgcatgtaccccttgaacctgaaataaaaattggaaagta

SEQ ID NO: 379760 - DNA, 4502 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagatacccttcatgagacccaactctgccacagctcatcctcggaggcaatcccggaaacctcttttataagtgtgattttaaaaatgtggattaaactctcgatagagtacataaagtaaaggagaacagctatattgtcctttctataagcttgtcactgcaaaaagttgccttttgcttgtcaggtttggatagaatataattgattggtttgttacttggactaacaaggcagtagatttgcctgtgtggaattttttttcctatttttcttctttttgctttttttgcacttatcagaaatatttgatgtgtgcattgttgaaaaatactggatacatgtcttgtcagaattgtcgtattaagtaatgtctttccctcttgcttctttggcaaatgttgatacacagtgtttggacttactgaagagttactgaagcctgtgggacttaataaatacaatatgctactccctgttgtgattgaacaatacaaataacaaacaagaaagacaatgcattccattagtctgctattctgtttccttcaacttcatacatagattcatatatgaagtactgcattgtaaaacaactatagactcatattaaatgttatttctatttataatattcagcaaaagtgaaagacttgtgaagcatatgacattctatttttgacttattagtcctagtgtgaaagcattaatattattagcatgaaatttttacttcagattttaagctcatgaataaagatatatctgtgttgatctctagatatttttagtaatacccaaatatattcagtccttattgttttaatataagctttctgtgttcagtataattttatttttctcaaccttaaatatgaacttaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatcttttcgggtatagtgacaatggaaaatagtttaaactttaggaatagagtaggtaatgttatagataatcaaaagcaattgtaattgtaaagctgctgtaatctagtgatctctagttacagtgaggaacgctatgattggatgagatgtttgataaaagtaaaatgtgtatgaaattacatataaacagattattagcttattgaaagatctcataacattggaggaaaaatattcataatctttagcaaaactagtagacttttgtttaa

SEQ ID NO: 379761 - DNA, 553 bp, Homo sapiens
gtaaatcctcatatccacagatataaaattataccgtgtccataatcggtccagctactataagcgagaaaactggactgtgtgctttaagaaacatatgtactaacatgattcatattatcacagatctacataagaaacccatggcacatcaggtaaatgatagttgtttatcacacagtagggaaaggaagaaacatgaaattgaattgcacttatacatgtaaattgtcaacatgtaatttggaattttctgattaataaatgtggttttggacatcttttcgggtatagtgacaatggaaaatagtttaaactttaggaatagagtaggtaatgttatagataatcaaaagcaattgtaattgtaaagctgctgtaatctagtgatctctagttacagtgaggaacgctatgattggatgagatgtttgataaaagtaaaatgtgtatgaaattacatataaacagattattagcttattgaaagatctcataacattggaggaaaaatattcataatctttagcaaaactagtagacttttgtttaa

SEQ ID NO: 379762 - DNA, 3380 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379763 - DNA, 2431 bp, Homo sapiens
tggtgctggggtgactctccggatcttaggcgttgtagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379764 - DNA, 3248 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcagtggcctcgttggcctcagcggtggagctctgcagccg

SEQ ID NO: 379765 - DNA, 3265 bp, Homo sapiens
  misc_feature (3212)..(3212): n is a, c, g, or t
  misc_feature (3231)..(3231): n is a, c, g, or t
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcacnagaggcggccgaaattttnttttcccttcttttgacaccgccccccccccccc

SEQ ID NO: 379766 - DNA, 3262 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcatcctgatgcggccgaaccccgcgcaacccccacccctctcccaaacccaatc

SEQ ID NO: 379767 - DNA, 760 bp, Homo sapiens
ctagggagcataactttcgcatctcagtccttctccatttcctgaggcttcttcaggctctggtgtgtggtccaccctggagaatgtctcgctctcctctcgagaggaacgtggctgcggctctgcgtggaccgtttggcagaggctcatatgctggatccactggttggttcacggggttcattcctgtctgttgatcttctacctagtggctccatcactcattcaaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379768 - DNA, 4288 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagatacccttcatgagacccaactctgccacagctcatcctcggaggcaatcccggaaacctcttttataagtgtgattttaaaaatgtggattaaactctcgatagagtacataaagtaaaggagaacagctatattgtcctttctataagcttgtcactgcaaattggactaacaaggcagtagatttgcctgtgtggaattttttttcctatttttcttctttttgctttttttgcacttatcagaaatatttgatgtgtgcattgttgaaaaatactggatacatgtcttgtcagaattgtcgtattaagtaatgtctttccctcttgcttctttggcaaatgttgatacacagtgtttggacttactgaagagttactgaagcctgtgggacttaataaatacaatatgctactccctgttgtgattgaacaatacaaataacaaacaagaaagacaatgcattccattagtctgctattctgtttccttcaacttcatacatagattcatatatgaagtactgcattgtaaaacaactatagactcatattaaatgttatttctatttataatattcagcaaaagtgaaagacttgtgaagcatatgacattctatttttgacttattagtcctagtgtgaaagcattaatattattagcatgaaatttttacttcagattttaagctcatgaataaagatatatctgtgttgatctctagatatttttagtaatacccaaatatattcagtccttattgttttaatataagctttctgtgttcagtataattttatttttctcaaccttaaatatgaacttaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatcttttcgggtatagtgacaatggaaaatagtttaaactttaggaatagagtaggtaatgttatagataatcaaaagcaattgtaattgtaaagctgctgtaatctagtgatctctagttacagtgaggaacgctatgattggatgagatgtttgataaaagtaaaatgtgtatgaaattacatataaacagattattagcttattgaaagatctcataacattggaggaaaaatattcataatctttagcaaaactagtagacttttgtttaa

SEQ ID NO: 379769 - DNA, 3230 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagacataatgctaatcagaaatcttagctgatgctgcacattggcttttcccaacggtccagaggctgctaattttagcggaaatgaagacattgatcaaagctctggtgagatgggggagtgagtgtgtgaacaaaaagagagctaatttaaaagaggcatcagactttcaaaggacagtgtcacaaaagttcttacagttcttacagggactttgtaagggaatccattcttatttctttaaaaaattgtcttctggtaaagccctgttaaattaactgaggacacagaaattaaacatttcaaaaagaataaacatattgataaaaca

SEQ ID NO: 379770 - DNA, 3326 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaagtgactaggtctcattgtgttgtccaggctgatctcaagcccctggggtcaagtgattcttccgcctctgcctccgaaaatgctaggattataggcatgagccaccatgcccagccaattttttttatattgttccttatctatgatttatttaataaggaattaagtgacagatcacttcaagaaataatacatttttgactgtattattttgttttcattttggaaataatacatgtttattacagattatttggaaaatgcagaaaaataaaagataaagaaaataaaagtcatgacctaccttc

SEQ ID NO: 379771 - DNA, 1925 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaaggagactaccatctagggttggtgactaaaattaagagtaattttcaaccttttgtatttcgtggagatcacgctctgcctcttcctctccaatataagagggggggtgggtacttaaatttttattttgtcacataaggatgttttagtattttattaaacatgctttatattaaaaacaagattaacagcaaagcaacctatataaattatcaccatcatttcccatattttaacataaaaactagggtatattatgtcctaaaataaaggataggcttttaaatttaataaattttactttagtaaagtaa

SEQ ID NO: 379772 - DNA, 467 bp, Homo sapiens
  misc_feature (37)..(37): n is a, c, g, or t
tcttaaatatttatcccatcacactcgttattctgtngcatatttcgcgttctttgaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379773 - DNA, 465 bp, Homo sapiens
  misc_feature (1)..(1): n is a, c, g, or t
  misc_feature (17)..(17): n is a, c, g, or t
  misc_feature (22)..(22): n is a, c, g, or t
  misc_feature (27)..(27): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (51)..(51): n is a, c, g, or t
ncccttttctccccccntcccnccccncacccccccccccnccnttnaggngtgaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379774 - DNA, 556 bp, Homo sapiens
tacaggtaagaaaactgagaatgaggggtcatatgcctttcacagagtcaaaccaatagttaagtgccaaagcaggattcaaaataagatttgtctgacaccaaagcctgtgcattttctgctgtgctcatgtagatgttttaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379775 - DNA, 467 bp, Homo sapiens
ttctcgacatctatctattttatttctacagatccccaaccccctcccttcagcagaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379776 - DNA, 457 bp, Homo sapiens
gtttatctcttctaagcattatattctatacccaacacaaacttatggagtaacaaatgaggctgctaaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379777 - DNA, 462 bp, Homo sapiens
acacccctatctccttttatatctaacagtcccaacacccaccgcggcctatgtggtaaccaatgaagctgctaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379778 - DNA, 239 bp, Homo sapiens
gagattaccgctgcttgcatattggtgtatgtttttctagcttttctttttaccattatttaacaaatatctactaagcatcttgtaagtgtaacacccactaatagtacaggggaatactctggtattcttgcaggtcataacctttatcctcttgatgtttatggcctataaaatgtatctagacaagtgacatgaaaactggaagaaaaacccaaggtgctcttaaaacaggtacc

SEQ ID NO: 379779 - DNA, 409 bp, Homo sapiens
gggggttgcaagaagaagaagagtaaagttcttagcagaaacagtgctgatgatgaggaactgaccaatgatagcctgaccctatctcaaagcaagagtaatgaggtagatcaacccaatttttatatctgtctgtctggggaaaagggaattcttctctaaatcactctacacattgtattaagtggcttccttgaaatcctatttatagacggctgtgggatgaatgagcaccctaactgtaacattttttcatttggccaacagacttttattaaatatctactatttgtcaccgttctcaaggagctcacaatctctgtcctcaaggagaaatatttagagaaatatttttatatccatagacttgggaaatgacaaagttttccattctcctttttatcccttt

SEQ ID NO: 379780 - DNA, 625 bp, Homo sapiens
gcgagattttaacatttgattacagaattctcttggtagtattttgagatggcaagcgttttatatgtttgttttgtgtgtgggaattttattaaaagatttgatagcaaaatcatatcttctcttcttagatgggttcatattgtttgtgccctgtatgttcctggagtagcctttggagatattgacaaattacgaccagtaacactaacggaaatgaactattccaaatatggtgccaaggtgagacacaaagcatttttgattgcttgaaagagaaaggttttacttgttagtttacctggctttttatttgtattatgttgactgcagaaatgcttactaggaatcattctatttagcactaaatcatttattattgatagtagttttcctagaaagccaataatgcataaattcttctatacattcttaatttagagtaacgtatgaggtaaaatgataattggtactactaccatttccctggcagtgttcacaatgcctaatacatagaccaaaaccttatttacaattagatggatcaaatataagcctaatttctgactttacttttgaagtggaatttgtcaaaattatgaaaaagaatattagaagtgatctt

SEQ ID NO: 379781 - DNA, 442 bp, Homo sapiens
atatgctataataatttgtaaataaaatatataaacttcatttagcataaatgttttctatcaataaccatgaaacattatttttattttttgtagtgactaggtctcattgtgttgtccaggctgatctcaagcccctggggtcaagtgattcttccgcctctgcctccgaaaatgctaggattataggcatgagccaccatgcccagccaattttttttatattgttccttatctatgatttatttaataaggaattaagtgacagatcacttcaagaaataatacatttttgactgtattattttgttttcattttggaaataatacatgtttattacagattatttggaaaatgcagaaaaataaaagataaagaaaataaaagtcatgacctaccttcgagagattaccgctgcttgcatattggtgtatgtttttc

SEQ ID NO: 379782 - DNA, 349 bp, Homo sapiens
tgacaagaacttaattagcactttcttattgcttatcaaaacaaatgtgttaaatgcttctcccttacgaaataaagaaaggtgaaaagatggcctaggttgattttattttttgttttgtctttgtttctttgtttcgttttggtactttatttttttttaatcagacataatgctaatcagaaatcttagctgatgctgcacattggcttttcccaacggtccagaggctgctaattttagcggaaatgaagacattgatcaaagctctggtgagatgggggagtgagtgtgtgaacaaaaagagagctaatttaaaagaggcatcagactttcaaaggacagtgtc

SEQ ID NO: 379783 - DNA, 3431 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379784 - DNA, 2803 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379785 - DNA, 3264 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcaccagatgcggcagatactgtgttgggaatggtatcatgatgaatttatacattt

SEQ ID NO: 379786 - DNA, 3265 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcaaccgggtcgcccgaaaccgcccctcccctcaaatggataattacataaaaaaaac

SEQ ID NO: 379787 - DNA, 955 bp, Homo sapiens
cgacacactctgatgggaaccggaacaccaacatctggagctgaccccctcctacaaggtgccagaaagaccaaacagttattgcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgttctcaataaagtcattcaaaatgaaataggagcttgtatttggaattcgtatattttagagtaatttcgacttttttattcaaaagctggacctttaaaagtttttaaaaggagaaaaattcttaactcaaatttgagaacagagacagaatgttattttttttgtaacctaactgttaacacatttaaatgacctaaaaaaaaaacctctgaaagtcttttttcttcttactag

SEQ ID NO: 379788 - DNA, 3460 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatcttttcgggtatagtgacaatggaaaatagtttaaactttaggaatagagtaggtaatgttatagataatcaaaagcaattgtaattgtaaagctgctgtaatctagtgatctctagttacagtgaggaacgctatgattggatgagatgtttgataaaagtaaaatgtgtatgaaattacatataaacagattattagcttattgaaagatctcataacattggaggaaaaatattcataatctttagcaaaactagtagacttttgtttaa
